US010344091B2

(12) United States Patent
Koide et al.

(10) Patent No.: US 10,344,091 B2
(45) Date of Patent: Jul. 9, 2019

(54) ANTI-GALECTIN-9 ANTIBODIES AND USES THEREOF

(71) Applicants: New York University, New York, NY (US); Puretech Health, LLC, Boston, MA (US)

(72) Inventors: Shohei Koide, New York, NY (US); George Miller, Englewood, NJ (US); Akiko Koide, New York, NY (US); Linxiao Chen, Weehawken, NJ (US); Eric Elenko, Boston, MA (US); Aleksandra Filipovic, London (GB); Joseph Bolen, Boston, MA (US)

(73) Assignees: New York University, New York, NY (US); PureTech Health, LLC, Boston, MA (US)

( * ) Notice: Subject to any disclaimer, the term of this patent is extended or adjusted under 35 U.S.C. 154(b) by 0 days.

(21) Appl. No.: 16/173,970

(22) Filed: Oct. 29, 2018

(65) Prior Publication Data

US 2019/0127472 A1     May 2, 2019

Related U.S. Application Data

(60) Provisional application No. 62/736,317, filed on Sep. 25, 2018, provisional application No. 62/665,175, filed on May 1, 2018, provisional application No. 62/578,111, filed on Oct. 27, 2017.

(51) Int. Cl.
| | | |
|---|---|---|
| *C07K 16/00* | (2006.01) | |
| *C07K 16/28* | (2006.01) | |
| *A61P 35/00* | (2006.01) | |
| *C07K 16/06* | (2006.01) | |
| *A61P 37/06* | (2006.01) | |

(52) U.S. Cl.
CPC .......... *C07K 16/2827* (2013.01); *A61P 35/00* (2018.01); *A61P 37/06* (2018.01); *C07K 16/065* (2013.01); *C07K 2317/565* (2013.01)

(58) Field of Classification Search
None
See application file for complete search history.

(56) References Cited

U.S. PATENT DOCUMENTS

| | | |
|---|---|---|
| 2014/0242095 A1 | 8/2014 | Wang et al. |
| 2017/0283499 A1 | 10/2017 | Delhem et al. |

FOREIGN PATENT DOCUMENTS

| | | |
|---|---|---|
| WO | 2016/061504 A2 | 4/2016 |

OTHER PUBLICATIONS

Tureci, O., et al., Molecular Definition of a Novel Human Galectin Which is Immunogenic in Patientw with Hodgkin's Disease, The Journal of Biological Chemistry, Mar. 7, 1997, vol. 272, No. 10, pp. 6416-6422.

Barjon, C., et al., A novel Monoclonal antibody for detection of galectin-9 in tissue sections: application to human tissues infected by oncogenic viruses, Infectious Agents and Cancer, 2012, voll 7, No. 16, pp. 1-11.

Tureci, O., et al., Molecular Definition of a Novel Human Galectin Which is Immunogenic in Patients with Hodgkin's Disease, The Journal of Biological Chemistry, Mar. 7, 1997, vol. 272, No. 10, pp. 6416-6422.

Barjon, C., et al., A novel monoclonal antibody for detection of galectin-9 in tissue sections: application to human tissues infected by oncogenic viruses, Infectious Agents and Cancer, Jul. 17, 2012, vol. 7, No. 16, 11 pages.

*Primary Examiner* — Lei Yao
(74) *Attorney, Agent, or Firm* — Hodgson Russ LLP

(57) ABSTRACT

Disclosed herein are anti-Galectin-9 antibodies and methods of using such for inhibiting a signaling pathway mediated by Galectin-9 or eliminating pathologic cells expressing Galectin-9. Such anti-Galectin-9 antibodies may also be used to diagnose and/or to treat diseases associated with Galectin-9, such as autoimmune diseases and solid tumors.

30 Claims, 43 Drawing Sheets

Specification includes a Sequence Listing.

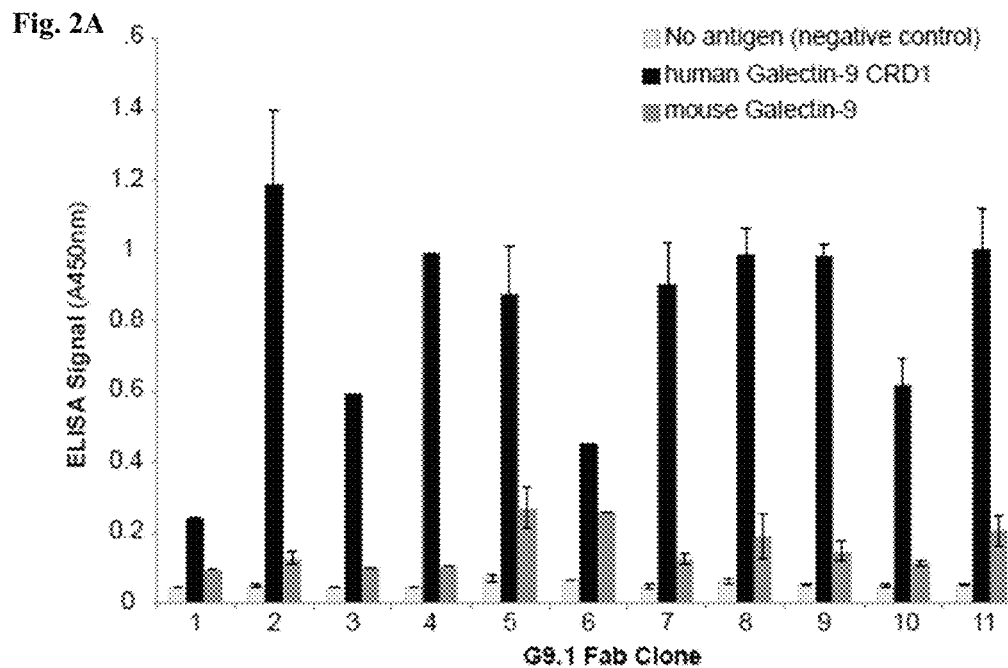
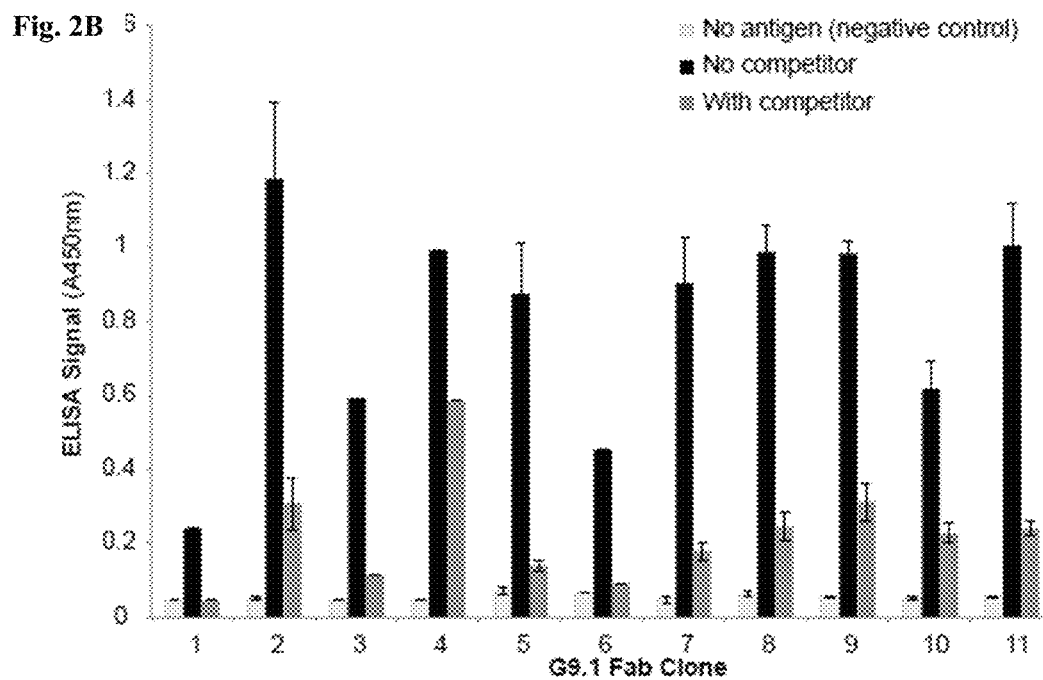

Fig. 7
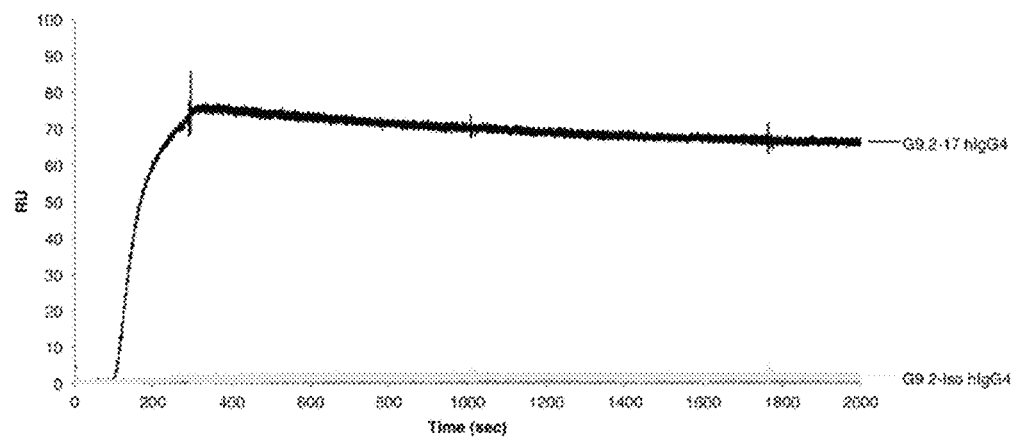
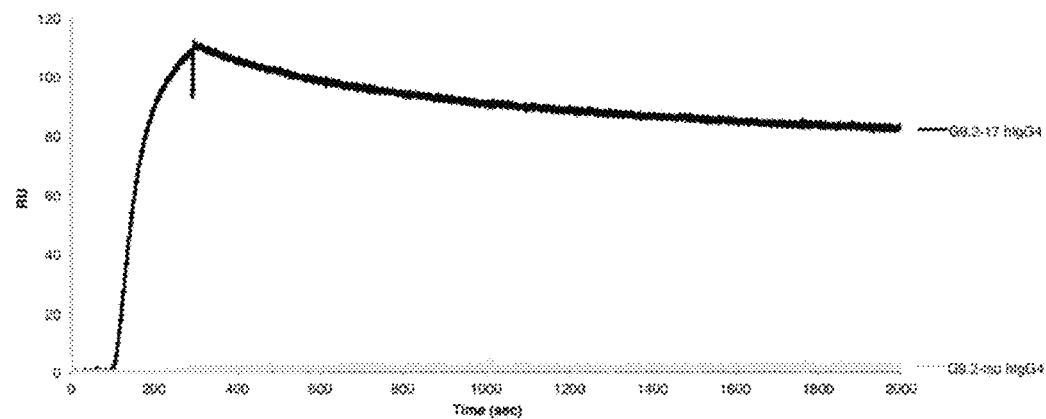

G9.1-8m8 mIgG2a

G9.1-8m9 mIgG2a

ANTI-GALECTIN-9 ANTIBODIES AND USES THEREOF

BACKGROUND OF INVENTION

Immune checkpoint blockade has demonstrated unprecedented success in the past few years as cancer treatment. Often antibodies are used to block immune inhibitory pathways, such as the cytotoxic T-lymphocyte-associated protein 4 (CTLA-4) and programmed death 1 (PD-1) pathways. While therapies targeting those two pathways have shown success in treating several cancer types, anti-CTLA-4 and anti-PD-1 therapies have a response rate of 10 to 60% of treated patients, depending on cancer type, and have not yet shown the ability to exceed a response rate of 60%, even when used in combination (Kyvistborg et al., Enhancing responses to cancer immunotherapy; Science. 2018 Feb. 2; 359(6375):516-517). Additionally, a large number of cancer types are refractory to these therapies. As part of efforts to improve existing immunotherapies in the clinic, the field has started to focus on the role of abnormalities in interferon signaling and upregulation of alternative checkpoints as potential causes for the limitation of current therapies. One such potential alternate checkpoint is T-cell immunoglobulin mucin-3 (Tim-3)/Galectin-9 (e.g., reviewed in Yang and Hung; The role of T-cell immunoglobulin mucin-3 and its ligand galectin-9 in antitumor immunity and cancer immunotherapy; Cancer biology and cancer treatment; October 2017, Vol. 60 No. 10: 1058-1064, and references therein).

Galectin-9 is a tandem-repeat lectin consisting of two carbohydrate recognition domains (CRDs) and was discovered and described for the first time in 1997 in patients suffering from Hodgkin's lymphoma (HL) (Tureci et al., J. Biol. Chem. 1997, 272, 6416-6422). Three isoforms exist, and can be located within the cell or extracellularly. Elevated Galectin-9 levels have been in observed a wide range of cancers, including melanoma, Hodgkin's lymphoma, hepatocellular, pancreatic, gastric, colon and clear cell renal cell cancers (Wdowiak et al. Int. J. Mol. Sci. 2018, 19, 210). In renal cancer, patients with high Galectin-9 expression showed more advanced progression of the disease with larger tumor size and necrosis (Kawashima et al.; BJU Int. 2014; 113:320-332). In melanoma—a cancer considered as one of the most lethal cancers due to its aggressive metastasis and resistance to therapy—Galectin-9 was expressed in 57% of tumors and was significantly increased in the plasma of patients with advanced melanoma compared to healthy controls (Enninga et al., Melanoma Res. 2016 October; 26(5): 429-441). A number of studies have shown utility for Gal-9 as a prognostic marker, and more recently as a potential new drug target (Enninga et al., 2016; Kawashima et al. BJU Int 2014; 113: 320-332; Kageshita et al., Int J Cancer. 2002 Jun. 20; 99(6):809-16, and references therein). Galectin-9 has been described to play an important role in in a number of cellular processes such as adhesion, cancer cell aggregation, apoptosis, and chemotaxis. Recent studies have shown a role for Galectin-9 in immune modulation in support of the tumor, e.g., through negative regulation of Th1 type responses, Th2 polarization and polarization of macrophages to the M2 phenotype. This work also includes studies that have shown that Galectin-9 participates in direct inactivation of T cells through interactions with the T-cell immunoglobulin and mucin protein 3 (TIM-3) receptor (Dardalhon et al., J Immunol., 2010, 185, 1383-1392; Sanchez-Fueyo et al., Nat Immunol., 2003, 4, 1093-1101). Galectin-9 has also been found to play a role in polarizing T cell differentiation into tumor suppressive phenotypes), as well as promoting tolerogenic macrophage programming and adaptive immune suppression (Daley et al., Nat Med., 2017, 23, 556-567). In mouse models of pancreatic ductal adenocarcinoma (PDA), blockade of the checkpoint interaction between Galectin-9 and the receptor Dectin-1 found on innate immune cells in the tumor microenvironment (TME) has been shown to increase anti-tumor immune responses in the TME and to slow tumor progression (Daley et al., Nat Med., 2017, 23, 556-567). Galectin-9 also has been found to bind to CD206, a surface marker of M2 type macrophages, resulting in a reduced secretion of CVL22 (MDC), a macrophage derived chemokine which has been associated with longer survival and lower recurrence risk in lung cancer (Enninga et al, J Pathol. 2018 August; 245(4): 468-477).

Accordingly, modulating the activity of Galectin-9 and/or one or more of its receptors may provide a novel cancer therapy approach, alone or in combination with existing therapies. Described herein are novel human antibodies which bind to human Galectin-9 and their therapeutic use in the treatment of cancer.

SUMMARY OF INVENTION

The present disclosure is based, at least in part, on the development of anti-Galectin-9 antibodies that potently suppress signaling triggered by Galectin-9. Such antibodies are capable of suppressing Galectin-9 signaling and/or eliminating Galectin-9 positive pathologic cells, thereby benefiting treatment of diseases associated with Galectin-9.

Accordingly, one aspect of the present disclosure provides an isolated anti-Galectin-9 antibody, which binds to an epitope in a carbohydrate recognition domain (CRD) of a Galectin-9 polypeptide, for example, a human Galectin-9 polypeptide. In some embodiments, the anti-Galactin-9 antibody described herein may bind to both a human Galactin-9 polypeptide and a non-human Galactin-9 polypeptide (e.g., a mouse Galactin-9, a rat Galactin-9, or a primate Galactin-9). In some embodiments, the anti-Galactin-9 antibody binds exclusively to one of the Galectin-9 CRDs. In some embodiments, the anti-Galactin-9 antibody binds to both of the Galectin-9 CRDs, e.g., with similar or different affinities. In some embodiments, the anti-Galactin-9 antibody disclosed herein binds an epitope within the CRD1 region. In some embodiments, the anti-Galactin-9 antibody disclosed herein binds an epitope within the CRD1 region, which CRD1 region may have the amino acid sequence of SEQ ID NO: 3. In some embodiments, the anti-Galectin-9 antibody disclosed herein binds an epitope within the CRD1 region having the amino acid sequence of SEQ ID NO: 3. In some embodiments, the anti-Galectin-9 antibody binds to the same epitope as a reference antibody selected from the group consisting of G9.1-1, G9.1-2, G9.1-3, G9.1-4, G9.1-5, G9.1-6, G9.1-7, G9.1-8, G9.1-8m1, G9.1-8m2, G9.1-8m3, G9.1-8m4, G9.1-8m5, G9.1-8m6, G9.1-8m7, G9.1-8m8, G9.1-8m9, G9.1-8m10, G9.1-8m11, G9.1-8m12, G9.1-8m13, G9.1-8m14, G9.1-9, G9.1-10, and G9.1-11 antibodies, and/or competes against the reference antibody from binding to the CRD1 region. In some embodiments, the anti-Galectin-9 antibody binds to the same epitope as antibody G9.1-8 or antibody G9.1-8m13 and/or competes against antibody G9.1-8 or antibody G9.1-8m13 from binding to the CRD1 region.

In some embodiments, the anti-Galectin-9 antibody disclosed herein is an antibody selected from the group consisting of G9.1-1, G9.1-2, G9.1-3, G9.1-4, G9.1-5, G9.1-6, G9.1-7, G9.1-8, G9.1-8m1, G9.1-8m2, G9.1-8m3, G9.1-

8m4, G9.1-8m5, G9.1-8m6, G9.1-8m7, G9.1-8m8, G9.1-8m9, G9.1-8m10, G9.1-8m11, G9.1-8m12, G9.1-8m13, G9.1-8m14, G9.1-9, G9.1-10, and G9.1-11 antibodies. In some embodiments, the anti-Galectin-9 antibody is G9.1-8 antibody. In some embodiments, the antibody is G9.1-8m13 antibody. In some examples, the anti-Galectin-9 antibody may comprise the same heavy chain complementarity determining regions (CDRs) and the same light chain CDRs as the reference antibody, e.g., any of the reference antibodies provided herein. In one specific example, the anti-Galectin-9 antibody comprises the same heavy chain variable region and the same light chain variable region as the reference antibody, e.g., any of the reference antibodies provided above and elsewhere herein.

In some embodiments, the anti-Galectin-9 antibody has a $V_L$ sequence comprising SEQ ID NO: 21 or consisting essentially of SEQ ID NO: 21 or consisting of SEQ ID NO: 21. In some embodiments, the anti-Galectin-9 antibody has a $V_H$ sequence comprising SEQ ID NO: 86 or consisting essentially of SEQ ID NO: 86 or consisting of SEQ ID NO: 86. In some embodiments, the anti-Galectin-9antibody has a $V_L$ sequence comprising SEQ ID NO: 21 and a $V_H$ sequence comprising SEQ ID NO: 86. In some embodiments, the anti-Galectin-9antibody has a $V_L$ sequence consisting essentially of SEQ ID NO: 21 and a $V_H$ sequence consisting essentially of SEQ ID NO: 86. In some embodiments, the anti-Galectin-9antibody has a $V_L$ sequence consisting of SEQ ID NO: 21 and a $V_H$ sequence consisting of SEQ ID NO: 86.

In some embodiments, the anti-Galectin antibody has a $V_H$ sequence comprising SEQ ID NO: 22 or consisting essentially of SEQ ID NO: 22 or consisting of SEQ ID NO: 22. In some embodiments, the anti-Galectin-9 antibody has a $V_L$ sequence comprising SEQ ID NO: 21 and a $V_H$ sequence comprising SEQ ID NO: 22. In some embodiments, the anti-Galectin-9antibody has a $V_L$ sequence consisting essentially of SEQ ID NO: 21 and a $V_H$ sequence consisting essentially of SEQ ID NO: 22. In some embodiments, the anti-Galectin-9antibody has a $V_L$ sequence consisting of SEQ ID NO: 21 and a $V_H$ sequence consisting of SEQ ID NO: 22.

In some embodiments, the anti-Galectin-9 antibody has a $V_L$ sequence comprising one or more of the sequences set forth in SEQ ID NOs: 328, 329, and 337. In some embodiments, the anti-Galectin-9 antibody has a $V_H$ sequence comprising one or more of the sequences set forth in SEQ ID NOs: 361, 364, 374, 366, and 383. In some embodiments, the anti-Galectin-9 antibody has a $V_L$ sequence comprising one or more of the sequences set forth in SEQ ID NOs: 328, 329, and 337, and a $V_H$ sequence comprising one or more of the sequences set forth in SEQ ID NOs: 361, 364, and 374. In some embodiments, the anti-Galectin-9 antibody has a $V_L$ sequence comprising one or more of the sequences set forth in SEQ ID NOs: 328, 329, and 337, and a $V_H$ sequence comprising one or more of the sequences set forth in SEQ ID NOs: 361, 366, and 383.

In some embodiments, the anti-Galectin-9 antibody disclosed herein binds an epitope within the Galectin-9 CRD2 region. In some embodiments, the anti-Galectin-9 antibody disclosed herein binds an epitope within the Galectin-9 CRD2 region, which CRD2 region may have the amino acid sequence of SEQ ID NO: 4. In some embodiments, the anti-Galectin-9 antibody disclosed herein binds an epitope within the CRD2 region having the amino acid sequence of SEQ ID NO: 4. In some embodiments, the anti-Galectin-9 antibody binds an epitope within the Galectin-9 CRD2 region that comprises a tryptophan residue corresponding with residue W309 of SEQ ID NO: 1. In some embodiments, the anti-Galectin-9 antibody binds an epitope within the Galectin-9 CRD2 region that does not comprise one or more residues corresponding with R253, R271, Y330, R334, R341 and Y236 of SEQ ID NO: 1. In some embodiments, the anti-Galectin-9 antibody may bind an epitope within the Galectin-9 CRD2 region that comprises a tryptophan residue corresponding with residue W309 of SEQ ID NO: 1 and additionally does not comprise one or more residues corresponding to R253, R271, Y330, R334, R341 and Y236 of SEQ ID NO: 1. In some embodiments, the anti-Galectin-9 antibody binds to the same epitope as a reference antibody selected from the group consisting of G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, G9.2-26, and G9.2-low affinity binder antibodies, and/or competes against the reference antibody from binding to the CRD2 region. In some embodiments, the anti-Galectin-9 antibody binds to the same epitope as antibody G9.2-17 or antibody G9.2-17mut6 and/or competes against antibody G9.2-17 or antibody G92-17mut6 from binding to the CRD2 region. In some embodiments, the anti-Galectin-9 antibody is an antibody selected from the group consisting of G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, and G9.2-26 antibodies. In some embodiments, the anti-Galectin-9 antibody is G9.2-17 antibody or G9.2-17mut6 antibody. In some embodiments, the anti-Galectin-9 antibody has a $V_L$ sequence comprising SEQ ID NO: 54 or consisting essentially of SEQ ID NO: 54 or consisting of SEQ ID NO: 54. In some embodiments, the anti-Galectin-9 antibody has a $V_H$ sequence comprising SEQ ID NO: 55 or consisting essentially of SEQ ID NO: 55 or consisting of SEQ ID NO: 55. In some embodiments, the anti-Galectin-9antibody has a $V_L$ sequence comprising SEQ ID NO: 54 and a $V_H$ sequence comprising SEQ ID NO: 55. In some embodiments, the anti-Galectin-9antibody has a $V_L$ sequence consisting essentially of SEQ ID NO: 54 and a $V_H$ sequence consisting essentially of SEQ ID NO: 55. In some embodiments, the anti-Galectin-9antibody has a $V_L$ sequence consisting of SEQ ID NO: 54 and a $V_H$ sequence consisting of SEQ ID NO: 55. In some embodiments, the antibody has a $V_H$ sequence comprising SEQ ID NO: 56. In some embodiments, the antibody has a $V_H$ sequence consisting essentially of SEQ ID NO: 56 or consisting of SEQ ID NO: 56. In some embodiments, the isolated antibody has a $V_L$ sequence comprising SEQ ID NO: 54 and a $V_H$ sequence comprising SEQ ID NO: 56. In some embodiments, the isolated antibody has a $V_L$ sequence consisting essentially of SEQ ID NO: 54 and a $V_H$ sequence consisting essentially of SEQ ID NO: 56. In some embodiments, the isolated antibody has a $V_L$ sequence consisting of SEQ ID NO: 54 and a $V_H$ sequence consisting of SEQ ID NO: 56.

In some embodiments, the anti-Galectin-9 antibody has a $V_L$ sequence comprising one or more of the sequences set forth in SEQ ID NOs: 328, 329, and 352. In some embodiments, the anti-Galectin-9 antibody has a $V_H$ sequence comprising one or more of the sequences set forth in SEQ ID NOs: 361, 388, 406, and 407. In some embodiments, the anti-Galectin-9 antibody has a $V_L$ sequence comprising one or more of the sequences set forth in SEQ ID NOs: 328, 329, and 352, and a $V_H$ sequence comprising one or more of the sequences set forth in SEQ ID NOs: 361, 388, and 406. In some embodiments, the anti-Galectin-9 antibody has a $V_L$ sequence comprising one or more of the sequences set forth in SEQ ID NOs: 328, 329, and 352, and a $V_H$ sequence comprising one or more of the sequences set forth in SEQ ID NOs: 361, 388, and 407.

In some examples, the anti-Galectin-9 antibody may comprise the same heavy chain complementarity determining regions (CDRs) and the same light chain CDRs as the reference antibody, e.g., any of the reference antibodies provided herein. In one specific example, the anti-Galectin-9 antibody comprises the same heavy chain variable region and the same light chain variable region as a reference antibody, e.g., any of the reference antibodies provided herein. In some embodiments, the anti-Galectin-9 antibody comprises a heavy chain complementarity determining region 1 (CDR1), a heavy chain complementary determining region 2 (CDR2), and a heavy chain complementary determining region 3 (CDR3), which collectively are at least 90% (e.g., 90%, 91%, 92%, 93%, 94%, 95%, 96%, 97%, 98%, or 99%) identical to the heavy chain CDRs of a reference antibody, e.g., any of the reference antibodies provided herein. In some embodiments, the anti-Galectin-9 antibody comprises a light chain CDR1, a light chain CDR2, and a light chain CDR3, which collectively are at least 90% (e.g., 90%, 91%, 92%, 93%, 94%, 95%, 96%, 97%, 98%, or 99%) identical to the light chain CDRs of a reference antibody, e.g., any of the reference antibodies provided herein.

In some embodiments, the anti-Galectin-9 antibody comprises both a heavy chain complementarity determining region 1 (CDR1), a heavy chain complementary determining region 2 (CDR2), and a heavy chain complementary determining region 3 (CDR3), which collectively are at least 90% (e.g., 90%, 91%, 92%, 93%, 94%, 95%, 96%, 97%, 98%, or 99%) identical to the heavy chain CDRs of a reference antibody, e.g., any of the reference antibodies provided herein and a light chain CDR1, a light chain CDR2, and a light chain CDR3, which collectively are at least 90% (e.g., 90%, 91%, 92%, 93%, 94%, 95%, 96%, 97%, 98%, or 99%) identical to the light chain CDRs of a reference antibody, e.g., any of the reference antibodies provided herein. In some examples, the anti-Galectin-9 antibody may comprise the same heavy chain CDRs and the same light chain CDRs as the reference antibodies noted above. In one specific example, the anti-Galectin-9 antibody may comprise the same heavy chain variable region and the same light chain variable region as of a reference antibody, e.g., any of the reference antibodies provided herein. In some embodiments, the exemplary isolated anti-Galectin 9 antibodies which bind to CRD1 include G9.1-1, G9.1-2, G9.1-3, G9.1-4, G9.1-5, G9.1-6, G9.1-7, G9.1-8, G9.1-9, G9.1-10, G9.1-11, G9.1-8m1, G9.1-8m2, G9.1-8m3, G9.1-8m4, G9.1-8m5, G9.1-8m6, G9.1-8m7, G9.1-8m8, G9.1-8m9, G9.1-8m10, G9.1-8m11, G9.1-8m12, G9.1-8m13, and G9.1-8m14. In some embodiments, the exemplary isolated anti-Galectin 9 antibodies which bind to CRD2 include G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, G9.2-26, and G9.2-low affinity binder.

In some embodiments, the isolated anti-Galectin 9 antibodies, or antigen binding portion thereof, comprise heavy and light chain variable regions, wherein the light chain variable region comprises an amino acid sequence selected from SEQ ID NO: 29, 13, 34, 36, 38, 40, 42, 44, 46, 48, 34, 54, 58, 61, 63, 65, 73, 67, 69, and 71. In some embodiments, the light chain variable regions consists of an amino acid sequence selected from SEQ ID NO: 29, 13, 34, 36, 38, 40, 42, 44, 46, 48, 34, 54, 58, 61, 63, 65, 73, 67, 69, and 71. In some embodiments, the isolated anti-Galectin 9 antibodies, or antigen binding portions thereof, comprise heavy and light chain variable regions, wherein the heavy chain variable region comprises an amino acid sequence selected from SEQ ID NO: 30, 31, 32, 33, 35, 37, 39, 41, 43, 45, 47, 49, 50, 51, 52, 53, 55, 56, 57, 59, 60, 62, 64, 66, 68, 70, 72 and 73. In some embodiments, the heavy chain variable regions consists of an amino acid sequence selected from SEQ ID NO: 30, 31, 32, 33, 35, 37, 39, 41, 43, 45, 47, 49, 50, 51, 52, 53, 55, 56, 57, 59, 60, 62, 64, 66, 68, 70, 72 and 73.

In some embodiments, the isolated anti-Galectin 9 antibodies, or antigen binding portion thereof, comprise heavy and light chain variable regions, wherein the light chain variable region comprises an amino acid sequence selected from SEQ ID NO: 29, 13, 34, 36, 38, 40, 42, 44, 46, 48, 34, 54, 58, 61, 63, 65, 73, 67, 69, and 71, and the heavy chain variable region comprises an amino acid sequence selected from SEQ ID NO: 30, 31, 32, 33, 35, 37, 39, 41, 43, 45, 47, 49, 50, 51, 52, 53, 55, 56, 57, 59, 60, 62, 64, 66, 68, 70, 72 and 73. In some embodiments, the isolated anti-Galectin 9 antibodies, or antigen binding portion thereof, comprise heavy and light chain variable regions, wherein the light chain variable region consists of an amino acid sequence selected from SEQ ID NO: 29, 13, 34, 36, 38, 40, 42, 44, 46, 48, 34, 54, 58, 61, 63, 65, 73, 67, 69, and 71, and the heavy chain variable region consists of an amino acid sequence selected from SEQ ID NO: 30, 31, 32, 33, 35, 37, 39, 41, 43, 45, 47, 49, 50, 51, 52, 53, 55, 56, 57, 59, 60, 62, 64, 66, 68, 70, 72 and 73.

In some embodiments, the isolated anti-Galectin 9 antibodies, or antigen binding portions thereof, comprise heavy and light chain variable regions, wherein the light chain variable region comprises an amino acid sequence selected from SEQ ID NO: 7, 9, 11, 13, 15, 17, 19, 21, 23, 25, and 27. In some embodiments, the light chain variable regions consist of an amino acid sequence selected from SEQ ID NO: 7, 9, 11, 13, 15, 17, 19, 21, 23, 25, and 27. In some embodiments, the isolated anti-Galectin 9 antibodies, or antigen binding portions thereof, comprise heavy and light chain variable regions, wherein the heavy chain variable region comprises an amino acid sequence selected from SEQ ID NO: 8, 10, 12, 14, 16, 18, 20, 22, 24, 26, 28, 74, 75, 76, 77, 78, 79, 80, 81, 82, 83, 84, 85, 86, and 87. In some embodiments, the heavy chain variable regions consist of an amino acid sequence selected from SEQ ID NO: 8, 10, 12, 14, 16, 18, 20, 22, 24, 26, 28, 74, 75, 76, 77, 78, 79, 80, 81, 82, 83, 84, 85, 86, and 87. Accordingly, in some embodiments, provided herein are isolated anti-Galectin 9 antibodies, or antigen binding portions thereof, comprising heavy and light chain variable regions, wherein the light chain variable region comprises an amino acid sequence selected from SEQ ID NO: 7, 9, 11, 13, 15, 17, 19, 21, 23, 25, and 27 and the heavy chain variable region comprises an amino acid sequence selected from SEQ ID NO: 8, 10, 12, 14, 16, 18, 20, 22, 24, 26, 28, 74, 75, 76, 77, 78, 79, 80, 81, 82, 83, 84, 85, 86, and 87. In some embodiments, the light chain variable regions consists of an amino acid sequence selected from SEQ ID NO: 7, 9, 11, 13, 15, 17, 19, 21, 23, 25, and 27, and the heavy chain variable regions consists of an amino acid sequence selected from SEQ ID NO: 8, 10, 12, 14, 16, 18, 20, 22, 24, 26, 28, 74, 75, 76, 77, 78, 79, 80, 81, 82, 83, 84, 85, 86, and 87.

In some embodiments, any of the anti-Galectin-9 antibody disclosed herein may comprise a heavy chain variable domain ($V_H$) that is at least 85% identical to the $V_H$ of a reference antibody disclosed herein. Alternatively or in addition, the anti-Galectin-9 antibody may comprise a light chain variable domain ($V_L$) that is at least 85% identical to the $V_L$ of the reference antibody.

In some embodiments, the anti-Galectin-9 antibody or antigen binding portion thereof comprises a VL region comprising SEQ ID NO: 54. In some embodiments, the anti-Galectin-9 antibody or antigen binding portion thereof comprises a VH region comprising SEQ ID NO: 55. In some embodiments, the anti-Galectin-9 antibody comprises a VL region consisting of SEQ ID NO: 54. In some embodiments, the anti-Galectin-9 antibody or antigen binding portion thereof comprises a VH region consisting of SEQ ID NO: 55. In some embodiments, the anti-Galectin-9 antibody comprises a VL and VH region comprising SEQ ID NO: 54 and 55, respectively. In some specific embodiments, the anti-Galectin-9 antibody or antigen binding portion thereof comprises a VL and VH region consisting of SEQ ID NO: 54 and 55, respectively. In some embodiments, the anti-Galectin-9 antibody is clone 9.2-17. In some embodiments, the anti-Galectin-9 antibody or antigen binding portion thereof comprises a VH region comprising SEQ ID NO: 56. In some embodiments, the anti-Galectin-9 antibody comprises a VL and VH region comprising SEQ ID NO: 54 and 56, respectively. In some specific embodiments, the anti-Galectin-9 antibody or antigen binding portion thereof comprises a VL and VH region consisting of SEQ ID NO: 54 and 56, respectively. In some embodiments, the anti-Galectin-9 antibody is clone 9.2-17 mut6.

In some embodiments, the anti-Galectin-9 antibody comprises a VL region comprising SEQ ID NO: 21. In some embodiments, the anti-Galectin-9 antibody comprises a VL region consisting of SEQ ID NO: 21. In some embodiments, the anti-Galectin-9 antibody comprises a VH region comprising SEQ ID NO: 86. In some embodiments, the anti-Galectin-9 antibody or antigen binding portion thereof comprises a VH region consisting of SEQ ID NO: 86. In some embodiments, the anti-Galectin-9 antibody comprises a VL and VH region comprising SEQ ID NO: 21 and 86, respectively. In some embodiments, the anti-Galectin-9 antibody comprises a VL and VH region consisting of SEQ ID NO: 21 and 86, respectively. In some embodiments, the anti-Galectin-9 antibody is clone G9.1-8m13. In some embodiments, the anti-Galectin-9 antibody comprises a VH region comprising SEQ ID NO: 22. In some embodiments, the anti-Galectin-9 antibody or antigen binding portion thereof comprises a VH region consisting of SEQ ID NO: 22. In some embodiments, the anti-Galectin-9 antibody comprises a VL and VH region comprising SEQ ID NO: 21 and 22, respectively. In some embodiments, the anti-Galectin-9 antibody comprises a VL and VH region consisting of SEQ ID NO: 21 and 22, respectively. In some embodiments, the anti-Galectin-9 antibody is clone G9.1-8.

In some embodiments, the anti-Galectin-9 antibody or antigen binding portion thereof comprises a VL region which has the same amino acid sequence as the VL region of antibody 9.1-8m13 (SEQ ID NO: 21). In some embodiments, the anti-Galectin-9 antibody or antigen binding portion thereof comprises a VH region which has the same amino acid sequence as the VH region of antibody 9.1-8m13 (SEQ ID NO: 86). In some embodiments, the anti-Galectin-9 antibody comprises VL and VH regions which have the same amino acid sequences as the VL and VH regions of antibody 9.1-8m13 (SEQ ID NO: 21 and 86, respectively).

In some embodiments, the anti-Galectin-9 antibody or antigen binding portion thereof comprises a VL region which has the same amino acid sequence as the VL region of antibody 9.2-17 (SEQ ID NO: 54). In some embodiments, the anti-Galectin-9 antibody or antigen binding portion thereof comprises a VH region which has the same amino acid sequence as the VH region of antibody 9.2-17 (SEQ ID NO: 55). In some embodiments, the anti-Galectin-9 antibody comprises VL and VH regions which have the same amino acid sequences as the VL and VH regions of 9.2-17 (SEQ ID NO: 54 and 55, respectively).

In some embodiments, the anti-Galectin-9 antibody comprises a VL region that has at least 80% (e.g., 85%, 90%, 95%, 96%, 97%, 98%, 99% and any increment therein) sequence identity to a VL region set forth in SEQ ID NO: 7, 9, 11, 13, 15, 17, 19, 21, 23, 25, and 27. In some embodiments, the anti-Galectin-9 antibody comprises a VH region that has at least 80% (e.g., 85%, 90%, 95%, 96%, 97%, 98%, 99% and any increment therein) sequence identity to a VH region set forth in SEQ ID NOs: 8, 10, 12, 14, 16, 18, 20, 22, 24, 26, 28, 74, 75, 76, 77, 78, 79, 80, 81, 82, 83, 84, 85, 86, and 87. In some embodiments, the anti-Galectin-9 antibody comprises a VL region that has at least 80% (e.g., 85%, 90%, 95%, 96%, 97%, 98%, 99% and any increment therein) sequence identity to a VL region set forth in SEQ ID NOs: 7, 9, 11, 13, 15, 17, 19, 21, 23, 25, and 27 and a VH region that has at least 80% (e.g., 85%, 90%, 95%, 96%, 97%, 98%, 99% and any increment therein) sequence identity to a VH region set forth in SEQ ID NOs: 8, 10, 12, 14, 16, 18, 20, 22, 24, 26, 28, 74, 75, 76, 77, 78, 79, 80, 81, 82, 83, 84, 85, 86, and 87.

In some embodiments, the anti-Galectin-9 antibody comprises a VL region that has at least 80% (e.g., 85%, 90%, 95%, 96%, 97%, 98%, 99% and any increment therein) sequence identity to a VL region set forth in SEQ ID NOs: 13, 29, 34, 36, 38, 40, 42, 44, 46, 48, 29, 34, 54, 58, 61, 63, 65, 73, 67, 69, and 71. In some embodiments, the anti-Galectin-9 antibody comprises a VH region that has at least 80% (e.g., 85%, 90%, 95%, 96%, 97%, 98%, 99% and any increment therein) sequence identity to a VH region set forth in SEQ ID NOs: 30, 31, 32, 33, 35, 37, 39, 41, 43, 45, 47, 49, 50, 51, 52, 53, 55, 56, 57, 59, 60, 62, 64, 66, 68, 70, 72 and 73. In some embodiments, the anti-Galectin-9 antibody comprises a VL region that has at least 80% (e.g., 85%, 90%, 95%, 96%, 97%, 98%, 99% and any increment therein) sequence identity to a VL region set forth in SEQ ID NOs: 13, 29, 34, 36, 38, 40, 42, 44, 46, 48, 29, 34, 54, 58, 61, 63, 65, 73, 67, 69, and 71 and a VH region that has at least 80% (e.g., 85%, 90%, 95%, 96%, 97%, 98%, 99% and any increment therein) sequence identity to a VH region set forth in SEQ ID NOs: 30, 31, 32, 33, 35, 37, 39, 41, 43, 45, 47, 49, 50, 51, 52, 53, 55, 56, 57, 59, 60, 62, 64, 66, 68, 70, 72 and 73.

In some embodiments, the anti-Galectin-9 antibody or antigen binding portion thereof comprises a VL region that has at least 80% (e.g., 85%, 90%, 95%, 96%, 97%, 98%, 99% and any increment therein) sequence identity to the VL region set forth in SEQ ID NO: 21.

In some embodiments, the anti-Galectin-9 antibody or antigen binding portion thereof comprises a VH region that has at least 80% (e.g., 85%, 90%, 95%, 96%, 97%, 98%, 99% and any increment therein) sequence identity to the VH region set forth in SEQ ID NO: 86. In some embodiments, the anti-Galectin-9 antibody or antigen binding portion thereof comprises a VL and VH region that have at least 80% (e.g., 85%, 90%, 95%, 96%, 97%, 98%, 99% and any increment therein) sequence identity to the VL and VH regions set forth in SEQ ID NO: 21 and 86, respectively.

In some specific embodiments, the anti-Galectin-9 antibody or antigen binding fragment thereof comprises a VL that has at least 80% (e.g., 85%, 90%, 95%, 96%, 97%, 98%, 99% and any increment therein) sequence identity to a VL region set forth in SEQ ID NO: 54. In some specific embodiments, the anti-Galectin-9 antibody or antigen binding fragment thereof comprises a VH region that has at least 80% (e.g., 85%, 90%, 95%, 96%, 97%, 98%, 99% and any increment therein) sequence identity to a VH region set forth in SEQ ID NO: 55. In some specific embodiments, the anti-Galectin-9 antibody or antigen binding fragment thereof comprises a VL and/or VH region that has at least 80% (e.g., 85%, 90%, 95%, 96%, 97%, 98%, 99% and any increment therein) sequence identity to a VL and/or VH region set forth in SEQ ID NO: 54 and 55, respectively. In some specific embodiments, the anti-Galectin-9 antibody comprises a VL region that has at least 80% (e.g., 85%, 90%, 95%, 96%, 97%, 98%, 99% and any increment therein) sequence identity to the VL region of G9.1-8m13. In some specific embodiments, the anti-Galectin-9 antibody comprises a VH region that has at least 80% (e.g., 85%, 90%, 95%, 96%, 97%, 98%, 99% and any increment therein) sequence identity to the VH region of G9.1-8m13. In some specific embodiments, the anti-Galectin-9 antibody comprises VL and VH regions that has at least 80% (e.g., 85%, 90%, 95%, 96%, 97%, 98%, 99% and any increment therein) sequence identity to VL and VH regions of G9.1-8m13. In some specific embodiments, the anti-Galectin-9 antibody comprises a VL region that has at least 80% (e.g., 85%, 90%, 95%, 96%, 97%, 98%, 99% and any increment therein) sequence identity to the VL region of G9.2-17. In some specific embodiments, the anti-Galectin-9 antibody comprises a VH region that has at least 80% (e.g., 85%, 90%, 95%, 96%, 97%, 98%, 99% and any increment therein) sequence identity to the VH region of G9.2-17. In some specific embodiments, the anti-Galectin-9 antibody comprises VL and VH regions that has at least 80% (e.g., 85%, 90%, 95%, 96%, 97%, 98%, 99% and any increment therein) sequence identity to VL and VH regions of G9.2-17.

Accordingly, in some embodiments, anti-Galectin-9 antibodies or antigen binding portions thereof comprise (a) VL CDR1 amino acid sequence set forth in SEQ ID NO: 328; (b) VL CDR2 amino acid sequence set forth in SEQ ID NO: 329; (c) VL CDR3 amino acid sequence selected from SEQ ID NO: 341-360; (d) VH CDR1 amino acid sequence set forth in SEQ ID NO: 361, 427, 428, 431, 435, 436, 437; (d) VH CDR2s amino acid sequence selected from SEQ ID NO: 362, 363, 387-389 and 446-466; (e) VH CDR3 amino acid sequence selected from SEQ ID NO: 390-417. Accordingly, in some embodiments, anti-Galectin-9 antibodies or antigen binding portions thereof comprise (a) VL CDR1 amino acid sequence set forth in SEQ ID NO: 328; (b) VL CDR2 amino acid sequence set forth in SEQ ID NO: 329; (c) VL CDR3 amino acid sequence selected from SEQ ID NO: 330-340; (d) VH CDR1 amino acid sequence set forth in SEQ ID NO: 361, 424-434; (e) VH CDR2 amino acid sequence selected from SEQ ID NO: 362-366 and 438-445; (f) VH CDR3 amino acid sequence selected from SEQ ID NO: 367-386.

In some embodiments, the anti-Galectin-9 antibody or binding portion thereof comprises heavy and light chain variable regions, wherein the light chain variable region CDR1 comprises SEQ ID NO: 328. In some embodiments, the anti-Galectin-9 antibody or binding portion thereof comprises heavy and light chain variable regions, wherein the light chain variable region CDR2 comprises $X_1X_2X_3X_4X_5SX_6X_7X_8SYADSVKG$ (SEQ ID NO: 467), in which $X_1$=Y or S, $X_2$=I or S, $X_3$=Y or S, $X_4$=P or S, $X_5$=Y or S, $X_6$=G or S, $X_7$=Y or S, and $X_8$=T or S. In some embodiments, the anti-Galectin-9 antibody or binding portion thereof comprises heavy and light chain variable regions, wherein the light chain variable region CDR3 comprises $X_1SX_2X_3X_4X_5X_6X_7X_8X_9X_{10}KX_{11}X_{12}X_{13}GMDY$ (SEQ ID NO: 468), in which $X_1$=Y or S, $X_2$=T, S, or absent, $X_3$=Y, S, or absent, $X_4$=S or absent, $X_5$=W, S, or absent, $X_6$=S or absent, $X_7$=G, S, or absent, $X_8$=G, T, S, or absent, $X_9$=I, Y, S, or absent, $X_{10}$=G, S, or Y, $X_{11}$=W or S, $X_{12}$=V or S, and $X_{13}$=W or S. In some embodiments, the anti-Galectin-9 antibody or binding portion thereof comprises heavy and light chain variable regions, wherein the light chain variable region CDR1 consists of SEQ ID NO: 328. In some embodiments, the anti-Galectin-9 antibody or binding portion thereof comprises heavy and light chain variable regions, wherein the light chain variable region CDR2 consists of $X_1X_2X_3X_4X_5SX_6X_7X_8SYADSVKG$ (SEQ ID NO: 467), in which $X_1$=Y or S, $X_2$=I or S, $X_3$=Y or S, $X_4$=P or S, $X_5$=Y or S, $X_6$=G or S, $X_7$=Y or S, and $X_8$=T or S. In some embodiments, the anti-Galectin-9 antibody or binding portion thereof comprises heavy and light chain variable regions, wherein the light chain variable region CDR3 consists of $X_1SX_2X_3X_4X_5X_6X_7X_8X_9X_{10}KX_{11}X_{12}X_{13}GMDY$ (SEQ ID NO: 468), in which $X_1$=Y or S, $X_2$=T, S, or absent, $X_3$=Y, S, or absent, $X_4$=S or absent, $X_5$=W, S, or absent, $X_6$=S or absent, $X_7$=G, S, or absent, $X_8$=G, T, S, or absent, $X_9$=I, Y, S, or absent, $X_{10}$=G, S, or Y, $X_{11}$=W or S, $X_{12}$=V or S, and $X_{13}$=W or S.

In some embodiments, the anti-Galectin-9 antibody or binding portion thereof comprises heavy and light chain variable regions, wherein the light chain variable region CDR1 comprises SEQ ID NO: 328. In some embodiments, the anti-Galectin-9 antibody or binding portion thereof comprises heavy and light chain variable regions, wherein the light chain variable region CDR2 comprises SEQ ID NO: 329. In some embodiments, the anti-Galectin-9 antibody or binding portion thereof comprises heavy and light chain variable regions, wherein the light chain variable region CDR3 comprises SEQ ID NO: 337. In some embodiments, the anti-Galectin-9 antibody or binding portion thereof comprises heavy and light chain variable regions, wherein the light chain variable region CDR1 consists of SEQ ID NO: 328. In some embodiments, the anti-Galectin-9 antibody or binding portion thereof comprises heavy and light chain variable regions, wherein the light chain variable region CDR2 consists of SEQ ID NO: 329. In some embodiments, the anti-Galectin-9 antibody or binding portion thereof comprises heavy and light chain variable regions, wherein the light chain variable region CDR3 consists of SEQ ID NO: 337. In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 337, respectively. In some embodiments, the light chain variable region CDR1, CDR2, and CDR3 regions consist of SEQ ID NO: 328, 329, and 337, respectively. In some embodiments, the antibody comprises the same VL CDRs as G9.1-8m13. In some embodiments, the anti-Galectin-9 antibody or binding portion thereof comprises heavy and light chain variable regions, wherein the heavy chain variable region CDR1 comprises SEQ ID NO: 361. In some embodiments, the anti-Galectin-9 antibody or binding portion thereof comprises heavy and light chain variable regions, wherein the heavy chain variable region CDR2 comprises SEQ ID NO: 366. In some embodiments, the anti-Galectin-9 antibody or binding portion thereof comprises heavy and light chain variable regions, wherein the heavy chain variable region CDR3 region comprises SEQ ID NO: 383. In some embodiments, the anti-Galectin-9 antibody or binding portion thereof comprises heavy and light chain variable regions, wherein the heavy chain variable region CDR1 consists of SEQ ID NO: 361. In some embodiments, the anti-Galectin-9 antibody or binding portion thereof comprises heavy and light chain variable regions, wherein the heavy chain variable region CDR2 consists of SEQ ID NO: 366. In some embodiments, the anti-Galectin-9 antibody or binding portion thereof comprises heavy and light chain variable regions, wherein the heavy chain variable region CDR3 region consists of SEQ ID NO: 383. In some embodiments, the anti-Galectin-9 antibody or binding portion thereof comprises heavy and light chain variable regions, wherein the heavy chain variable region CDR1, CDR2, and CDR3 regions comprise SEQ ID NO: 361, 366, and 383, respectively. In some embodiments, the heavy chain variable region CDR1, CDR2, and CDR3 regions consist of SEQ ID NO: 361, 366, and 383, respectively. In some embodiments, the anti-Galectin-9 antibody comprises the same VH CDRs as G9.1-8m13. In one specific embodiment, the anti-Galectin-9 antibody or binding portion thereof comprises heavy and light chain variable regions, wherein: the light chain variable region CDR1, CDR2, and CDR3 comprise SEQ ID NO: 328, 329, and 337, respectively, and the heavy chain variable region CDR1, CDR2, and CDR3 comprise SEQ ID NO: 361, 366, and 383, respectively. In some embodiments, the light and heavy chain variable region CDR1, CDR2, and CDR3 regions consist of SEQ ID NO: 328, 329, and 337, respectively, and SEQ ID NO: 361, 366, and 383, respectively. In one specific embodiment, the anti-Galectin-9 antibody comprises the same VL and VH CDRs as G9.1-8m13.

In some embodiments, the anti-Galectin-9 antibody or binding portion thereof comprises heavy and light chain variable regions, wherein the light chain variable region CDR1 comprises SEQ ID NO: 328. In some embodiments, the anti-Galectin-9 antibody or binding portion thereof comprises heavy and light chain variable regions, wherein the light chain variable region CDR2 comprises SEQ ID NO: 329. In some embodiments, the anti-Galectin-9 antibody or binding portion thereof comprises heavy and light chain variable regions, wherein the light chain variable region CDR3 comprises SEQ ID NO: 352. In some embodiments, the anti-Galectin-9 antibody or binding portion thereof comprises heavy and light chain variable regions, wherein the light chain variable region CDR1 consists of SEQ ID NO: 328. In some embodiments, the anti-Galectin-9 antibody or binding portion thereof comprises heavy and light chain variable regions, wherein the light chain variable region CDR2 consists of SEQ ID NO: 329. In some embodiments, the anti-Galectin-9 antibody or binding portion thereof consists of heavy and light chain variable regions, wherein the light chain variable region CDR3 comprises SEQ ID NO: 352. In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 352, respectively. In some embodiments, the light chain variable region CDR1, CDR2, and CDR3 regions consist of SEQ ID NO: 328, 329, and 352, respectively. In some embodiments, the anti-Galectin-9 antibody comprises the same VL CDRs as G9.2-17. In some embodiments, the anti-Galectin-9 antibody or binding portion thereof comprises heavy and light chain variable regions, wherein the heavy chain variable region CDR1, CDR2, and CDR3 regions comprise SEQ ID NO: 361, 388, and 406, respectively. In some embodiments, the heavy chain variable region CDR1, CDR2, and CDR3 regions consist of SEQ ID NO: 361, 388, and 406, respectively. In some embodiments, the antibody comprises the same VH CDRs as G9.2-17. In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 352, respectively, and the heavy chain variable region CDR1, CDR2, and CDR3 comprise SEQ ID NO: 361, 388, and 406, respectively. In some embodiments, the light and heavy chain variable region CDR1, CDR2, and CDR3 regions consist of SEQ ID NO: 328, 329, and 352, respectively, and SEQ ID NO: 361, 388, and 406, respectively. In one specific embodiment, the anti-Galectin-9 antibody comprises the same VL and VH CDRs as G9.2-17.

Accordingly, in some embodiments, anti-Galectin-9 antibodies or antigen binding portions thereof comprise (a) VL CDR1 amino acid sequence that has at least 80% (e.g., 85%, 90%, 95%, 96%, 97%, 98%, 99% and any increment therein) sequence identity to the VL CDR1 amino acid sequence set forth in SEQ ID NO: 328; (b) VL CDR2 amino acid sequence that has at least 80% (e.g., 85%, 90%, 95%, 96%, 97%, 98%, 99% and any increment therein) sequence identity to the VL CDR2 amino acid sequence set forth in SEQ ID NO: 329; (c) VL CDR3 amino acid sequence that has at least 80% (e.g., 85%, 90%, 95%, 96%, 97%, 98%, 99% and any increment therein) sequence identity to a VL CDR3 amino acid sequence selected from SEQ ID NO: 330-340; (d) VH CDR1 amino acid sequence that has at least 80% (e.g., 85%, 90%, 95%, 96%, 97%, 98%, 99% and any increment therein) sequence identity to the VH CDR1 amino acid sequence set forth in SEQ ID NO: SEQ ID NO: 361, 427, 428, 431, 435, 436, 437; (e) VH CDR2 amino acid sequence that has at least 80% (e.g., 85%, 90%, 95%, 96%, 97%, 98%, 99% and any increment therein) sequence identity to a VH CDR2 amino acid sequence selected from SEQ ID NO: 362-366 and 438-445; (f) VH CDR3 amino acid sequence that has at least 80% (e.g., 85%, 90%, 95%, 96%, 97%, 98%, 99% and any increment therein) sequence identity to a VH CDR3 amino acid sequence selected from SEQ ID NO: 367-386. Accordingly, in some embodiments, anti-Galectin-9 antibodies or antigen binding portions thereof comprise (a) VL CDR1 amino acid sequence that has at least 80% (e.g., 85%, 90%, 95%, 96%, 97%, 98%, 99% and any increment therein) sequence identity to the VL CDR1 amino acid sequence set forth in SEQ ID NO: 328; (b) VL CDR2 amino acid sequence that has at least 80% (e.g., 85%, 90%, 95%, 96%, 97%, 98%, 99% and any increment therein) sequence identity to the VL CDR2 amino acid sequence set forth in SEQ ID NO: 329; (c) VL CDR3 amino acid sequence that has at least 80% (e.g., 85%, 90%, 95%, 96%, 97%, 98%, 99% and any increment therein) sequence identity to the VL CDR3 amino acid sequence selected from SEQ ID NO: 341-360; (d) VH CDR1 amino acid sequence that has at least 80% (e.g., 85%, 90%, 95%, 96%, 97%, 98%, 99% and any increment therein) sequence identity to the VH CDR1 amino acid sequence set forth in SEQ ID NO: 361, 424-434; (d) VH CDR2 amino acid sequence that has at least 80% (e.g., 85%, 90%, 95%, 96%, 97%, 98%, 99% and any increment therein) sequence identity to a VH CDR2 amino acid sequence selected from SEQ ID NO: 362, 363, 387-389 and 446-466; (e) VH CDR3 amino acid sequence that has at least 80% (e.g., 85%, 90%, 95%, 96%, 97%, 98%, 99% and any increment therein) sequence identity to a VH CDR3 amino acid sequence selected from SEQ ID NO: 390-417.

In some embodiments, the anti-Galectin-9 antibody or binding portion thereof comprises heavy and light chain variable regions, wherein the light chain variable region CDR1, CDR2, and CDR3 amino acid sequences have at least 80% (e.g., 85%, 90%, 95%, 96%, 97%, 98%, 99% and any increment therein) sequence identity to the light chain variable region CDR1, CDR2, and CDR3 amino acid sequences set forth in SEQ ID NO: 328, 329, and 337, respectively. In some embodiments, the antibody VL CDR1, CDR2, and CDR3 amino acid sequences have at least 80% (e.g., 85%, 90%, 95%, 96%, 97%, 98%, 99% and any increment therein) sequence identity to the VL CDR1, CDR2, and CDR3 amino acid sequences of G9.1-8m13. In some embodiments, the anti-Galectin-9 antibody or binding portion thereof comprises heavy and light chain variable regions, wherein the heavy chain variable region CDR1, CDR2, and CDR3 amino acid sequences have at least 80% (e.g., 85%, 90%, 95%, 96%, 97%, 98%, 99% and any increment therein) sequence identity to the heavy chain variable region CDR1, CDR2, and CDR3 amino acid sequences set forth in SEQ ID NO: 361, 366, and 383, respectively. In some embodiments, the antibody VH CDR1, CDR2, and CDR3 amino acid sequences have at least 80% (e.g., 85%, 90%, 95%, 96%, 97%, 98%, 99% and any increment therein) sequence identity to the VH CDR1, CDR2, and CDR3 amino acid sequences of G9.1-8m13. In one specific embodiment, the anti-Galectin-9 antibody or binding portion thereof comprises heavy and light chain variable regions, wherein: the light chain variable region CDR1, CDR2, and CDR3 amino acid sequences have at least 80% (e.g., 85%, 90%, 95%, 96%, 97%, 98%, 99% and any increment therein) sequence identity to the light chain variable region CDR1, CDR2, and CDR3 amino acid sequences set forth in SEQ ID NO: 328, 329, and 337, respectively, and the heavy chain variable region CDR1, CDR2, and CDR3 amino acid sequences have at least 80% (e.g., 85%, 90%, 95%, 96%, 97%, 98%, 99% and any increment therein) sequence identity to the heavy chain variable region CDR1, CDR2, and CDR3 amino acid sequences set forth in SEQ ID NO: 361, 366, and 383, respectively. In one specific embodiment, the antibody VL CDR1, CDR2, and CDR3 and VH CDR1, CDR2, and CDR3 amino acid sequences have at least 80% (e.g., 85%, 90%, 95%, 96%, 97%, 98%, 99% and any increment therein) sequence identity to the VL CDR1, CDR2, and CDR3 and VH CDR1, CDR2, and CDR3 amino acid sequences as G9.1-8m13. In some embodiments, the anti-Galectin-9 antibody or binding portion thereof comprises heavy and light chain variable regions, wherein the light chain variable region CDR1, CDR2, and CDR3 amino acid sequences have at least 80% (e.g., 85%, 90%, 95%, 96%, 97%, 98%, 99% and any increment therein) sequence identity to the light chain variable region CDR1, CDR2, and CDR3 amino acid sequences set forth in SEQ ID NO: 328, 329, and 352, respectively. In some embodiments, the antibody VL CDR1, CDR2, and CDR3 amino acid sequences have at least 80% (e.g., 85%, 90%, 95%, 96%, 97%, 98%, 99% and any increment therein) sequence identity to the VL CDR1, CDR2, and CDR3 amino acid sequences of G9.2-17. In some embodiments, the anti-Galectin-9 antibody or binding portion thereof comprises heavy and light chain variable regions, wherein the heavy chain variable region CDR1, CDR2, and CDR3 amino acid sequences have at least 80% (e.g., 85%, 90%, 95%, 96%, 97%, 98%, 99% and any increment therein) sequence identity to the heavy chain variable region CDR1, CDR2, and CDR3 amino acid sequences set forth in SEQ ID NO: 361, 388, and 406, respectively. In some embodiments, the antibody VH CDR1, CDR2, and CDR3 amino acid sequences have at least 80% (e.g., 85%, 90%, 95%, 96%, 97%, 98%, 99% and any increment therein) sequence identity to the VH CDR1, CDR2, and CDR3 amino acid sequences of G9.2-17. In some embodiments, the anti-Galectin-9 antibody or binding portion thereof comprises heavy and light chain variable regions, wherein the light chain variable region CDR1, CDR2, and CDR3 amino acid sequences have at least 80% (e.g., 85%, 90%, 95%, 96%, 97%, 98%, 99% and any increment therein) sequence identity to the light chain variable region CDR1, CDR2, and CDR3 amino acid sequences set forth in comprise SEQ ID NO: 328, 329, and 352, respectively, and the heavy chain variable region CDR1, CDR2, and CDR3 amino acid sequences have at least 80% (e.g., 85%, 90%, 95%, 96%, 97%, 98%, 99% and any increment therein) sequence identity to the heavy chain variable region CDR1, CDR2, and CDR3 amino acid sequences set forth in SEQ ID NO: 361, 388, and 406, respectively. In one specific embodiment, the antibody VL CDR1, CDR2, and CDR3 and VH CDR1, CDR2, and CDR3 amino acid sequences have at least 80% (e.g., 85%, 90%, 95%, 96%, 97%, 98%, 99% and any increment therein) sequence identity to the VL CDR1, CDR2, and CDR3 and VH CDR1, CDR2, and CDR3 amino acid sequences of G9.2-17.

In some embodiments of any of the anti-Galectin antibodies provided herein, the heavy chain constant region of the anti-Galectin-9 antibody is from a human IgG (a gamma heavy chain) of any IgG subfamily as described herein, e.g., IgG1 or IgG4.

In some embodiments, the amino acid sequences of exemplary anti-Galectin antibody light chains correspond to sequences set forth in SEQ ID NO: 88-98 and SEQ ID NO: 99-115. In some embodiments, the anti-Galectin-9 antibodies or antigen-binding portion thereof comprise a light chain sequence of SEQ ID NO: 108. In some embodiments, light chains of anti-Galectin-9 antibodies comprise an amino acid sequence that has at least 80% (e.g., 85%, 90%, 95%, 96%, 97%, 98%, 99% and any increment therein) sequence identity to the light chain sequence set forth in SEQ ID NO: 95 (or their variable regions). In some embodiments, light chains of anti-Galectin-9 antibodies comprise an amino acid sequence that has at least 80% (e.g., 85%, 90%, 95%, 96%, 97%, 98%, 99% and any increment therein) sequence identity to the light chain sequence set forth in SEQ ID NO: 108 (or their variable regions). In some embodiments, the amino acid sequences of exemplary anti-Galectin antibody heavy chains correspond to sequences set forth in SEQ ID NO: 116-140; 169-193; 222-246; 275-299 (anti-Galectin-9 antibodies binding to CRD1) and SEQ ID NO: 141-168; 194-220; 247-274; 300-327 (anti-Galectin-9 antibodies binding to CRD2). In some embodiments, the heavy chain constant region of the anti-Galectin-9 antibody is from a human IgG1. In some embodiments, the anti-Galectin-9 antibodies or antigen-binding portion thereof comprise a heavy chain sequence of SEQ ID NO: 136. In some embodiments, the IgG1 is a mutant with minimal Fc receptor engagement. In some embodiments, the anti-Galectin-9 antibodies or antigen-binding portion thereof comprise a heavy chain sequence of SEQ ID NO: 189. In some embodiments, the heavy chain constant region of the anti-Galectin-9 antibody is from a human IgG4. In some embodiments, the anti-Galectin-9 antibodies or antigen-binding portion thereof comprise a heavy chain sequence of SEQ ID NO: 242. In some embodiments, the IgG4 is IgG4 exchange mutant. In some embodiments, the anti-Galectin-9 antibodies or antigen-binding portion thereof comprise a heavy chain sequence of SEQ ID NO: 295.

In some embodiments, the anti-Galectin-9 antibodies or antigen-binding portion thereof comprise a heavy chain sequence of SEQ ID NO: 157. In some embodiments, the anti-Galectin-9 antibodies or antigen-binding portion thereof comprise a heavy chain sequence of SEQ ID NO: 210. In some embodiments, the anti-Galectin-9 antibodies or antigen-binding portion thereof comprise a heavy chain sequence of SEQ ID NO: 263. In some embodiments, the anti-Galectin-9 antibodies or antigen-binding portion thereof comprise a heavy chain sequence of SEQ ID NO: 316.

In some embodiments, heavy chains of anti-Galectin-9 antibodies comprise an amino acid sequence that has at least 80% (e.g., 85%, 90%, 95%, 96%, 97%, 98%, 99% and any increment therein) sequence identity to the heavy chain sequence set forth in SEQ ID NO: 136 (or its variable region). In some embodiments, heavy chains of anti-Galectin-9 antibodies comprise an amino acid sequence that has at least 80% (e.g., 85%, 90%, 95%, 96%, 97%, 98%, 99% and any increment therein) sequence identity to the heavy chain sequence set forth in SEQ ID NO: 189 (or its variable region). In some embodiments, heavy chains of anti-Galectin-9 antibodies comprise an amino acid sequence that has at least 80% (e.g., 85%, 90%, 95%, 96%, 97%, 98%, 99% and any increment therein) sequence identity to the heavy chain sequence set forth in SEQ ID NO: 242 (or its variable region). In some embodiments, heavy chains of anti-Galectin-9 antibodies comprise an amino acid sequence that has at least 80% (e.g., 85%, 90%, 95%, 96%, 97%, 98%, 99% and any increment therein) sequence identity to the heavy chain sequence set forth in SEQ ID NO: 295 (or its variable region). In some embodiments, heavy chains of anti-Galectin-9 antibodies comprise an amino acid sequence that has at least 80% (e.g., 85%, 90%, 95%, 96%, 97%, 98%, 99% and any increment therein) sequence identity to the heavy chain sequence set forth in SEQ ID NO: 157 (or its variable region). In some embodiments, heavy chains of anti-Galectin-9 antibodies comprise an amino acid sequence that has at least 80% (e.g., 85%, 90%, 95%, 96%, 97%, 98%, 99% and any increment therein) sequence identity to the heavy chain sequence set forth in SEQ ID NO: 210 (or its variable region). In some embodiments, heavy chains of anti-Galectin-9 antibodies comprise an amino acid sequence that has at least 80% (e.g., 85%, 90%, 95%, 96%, 97%, 98%, 99% and any increment therein) sequence identity to the heavy chain sequence set forth in SEQ ID NO: 263 (or its variable region). In some embodiments, heavy chains of anti-Galectin-9 antibodies comprise an amino acid sequence that has at least 80% (e.g., 85%, 90%, 95%, 96%, 97%, 98%, 99% and any increment therein) sequence identity to the heavy chain sequence set forth in SEQ ID NO: 316 (or its variable region). In some embodiments, the anti-Galectin-9 antibodies or antigen-binding portion thereof comprise a light chain sequence of SEQ ID NO: 95 and a heavy chain sequence of SEQ ID NO: 136. In some embodiments, the anti-Galectin-9 antibodies or antigen-binding portion thereof comprise a light chain sequence of SEQ ID NO: 95 and a heavy chain sequence of SEQ ID NO: 189. In some embodiments, the anti-Galectin-9 antibodies or antigen-binding portion thereof comprise a light chain sequence of SEQ ID NO: 95 and a heavy chain sequence of SEQ ID NO: 242.

In some embodiments, the anti-Galectin-9 antibodies or antigen-binding portion thereof comprise a light chain sequence of SEQ ID NO: 95 and a heavy chain sequence of SEQ ID NO: 295. In some embodiments, the anti-Galectin-9 antibodies or antigen-binding portion thereof comprise a light chain sequence of SEQ ID NO: 108 and a heavy chain sequence of SEQ ID NO: 157.

In some embodiments, the anti-Galectin-9 antibodies or antigen-binding portion thereof comprise a light chain sequence of SEQ ID NO: 108 and a heavy chain sequence of SEQ ID NO: 210.

In some embodiments, the anti-Galectin-9 antibodies or antigen-binding portion thereof comprise a light chain sequence of SEQ ID NO: 108 and a heavy chain sequence of SEQ ID NO: 263.

In some embodiments, the anti-Galectin-9 antibodies or antigen-binding portion thereof comprise a light chain sequence of SEQ ID NO: 108 and a heavy chain sequence of SEQ ID NO: 316.

In one embodiment, the anti-Galectin-9 antibody comprises a light chain amino acid sequence that has at least 80% (e.g., 85%, 90%, 95%, 96%, 97%, 98%, 99% and any increment therein) sequence identity to SEQ ID NO: 95 and a heavy chain amino acid sequence that has at least 80% (e.g., 85%, 90%, 95%, 96%, 97%, 98%, 99% and any increment therein) sequence identity to SEQ ID NO: 136. In one embodiment, the anti-Galectin-9 antibody comprises a light chain amino acid sequence that has at least 80% (e.g., 85%, 90%, 95%, 96%, 97%, 98%, 99% and any increment therein) sequence identity to SEQ ID NO: 95 and a heavy chain amino acid sequence that has at least 80% (e.g., 85%, 90%, 95%, 96%, 97%, 98%, 99% and any increment therein) sequence identity to SEQ ID NO: 189. In one embodiment, the anti-Galectin-9 antibody comprises a light chain amino acid sequence that has at least 80% (e.g., 85%, 90%, 95%, 96%, 97%, 98%, 99% and any increment therein) sequence identity to SEQ ID NO: 95 and a heavy chain amino acid sequence that has at least 80% (e.g., 85%, 90%, 95%, 96%, 97%, 98%, 99% and any increment therein) sequence identity to SEQ ID NO: 242. In one embodiment, the anti-Galectin-9 antibody comprises a light chain amino acid sequence that has at least 80% (e.g., 85%, 90%, 95%, 96%, 97%, 98%, 99% and any increment therein) sequence identity to SEQ ID NO: 95 and a heavy chain amino acid sequence that has at least 80% (e.g., 85%, 90%, 95%, 96%, 97%, 98%, 99% and any increment therein) sequence identity to SEQ ID NO: 295.

In one embodiment, the anti-Galectin-9 antibody comprises a light chain amino acid sequence that has at least 80% (e.g., 85%, 90%, 95%, 96%, 97%, 98%, 99% and any increment therein) sequence identity to SEQ ID NO: 108 and a heavy chain amino acid sequence that has at least 80% (e.g., 85%, 90%, 95%, 96%, 97%, 98%, 99% and any increment therein) sequence identity to f SEQ ID NO: 157. In one embodiment, the anti-Galectin-9 antibody comprises a light chain amino acid sequence that has at least 80% (e.g., 85%, 90%, 95%, 96%, 97%, 98%, 99% and any increment therein) sequence identity to SEQ ID NO: 108 and a heavy chain amino acid sequence that has at least 80% (e.g., 85%, 90%, 95%, 96%, 97%, 98%, 99% and any increment therein) sequence identity to SEQ ID NO: 210. In one embodiment, the anti-Galectin-9 antibody comprises a light chain amino acid sequence that has at least 80% (e.g., 85%, 90%, 95%, 96%, 97%, 98%, 99% and any increment therein) sequence identity to SEQ ID NO: 108 and a heavy chain amino acid sequence that has at least 80% (e.g., 85%, 90%, 95%, 96%, 97%, 98%, 99% and any increment therein) sequence identity to SEQ ID NO: 263. In one embodiment, the anti-Galectin-9 antibody comprises a light chain amino acid sequence that has at least 80% (e.g., 85%, 90%, 95%, 96%, 97%, 98%, 99% and any increment therein) sequence identity to SEQ ID NO: 108 and a heavy chain amino acid sequence that has at least 80% (e.g., 85%, 90%, 95%, 96%, 97%, 98%, 99% and any increment therein) sequence identity to SEQ ID NO: 316.

Any of the anti-Galectin-9 antibodies provided herein may comprise a heavy chain variable region framework of VH 3-48; and/or a light chain variable region framework of Vκ 1-39. In some embodiments, any of the VH and/or VL frameworks described herein are germline VH and/or VL genes. In some embodiments, the anti-Galectin-9 antibodies described herein is a full-length antibody (e.g., an IgG molecule) or an antigen-binding fragment thereof. In some examples, the antibody is a Fab or a single-chain antibody. In any instances, the antibody can be a human antibody or a humanized antibody.

In another aspect, the present disclosure provides an isolated nucleic acid or set of nucleic acids which encode or collectively encode any of the anti-Galectin-9 antibodies disclosed herein. In some instances, the heavy chain and light chain of the antibody are encoded by two separate nucleic acid molecules (a set of nucleic acids). In other instances, the heavy chain and light chain of the antibody are encoded by one nucleic acid molecule, which may be in multicistronic format, or under the control of distinct promoters. In some embodiments, the nucleic acid or set of nucleic acids are located on one or two vectors. In some examples, the one or two vectors can be one or two expression vectors. Further, the present disclosure provides a host cell comprising any of the isolated nucleic acid or set of nucleic acids coding for the anti-Galectin-9 antibodies described herein.

Also provided herein is a method for producing the anti-Galectin-9 antibody, comprising culturing the host cell described herein under suitable conditions allowing for expressing of the antibody, and harvesting the antibody thus produced from the cell culture (e.g., from the culture medium).

Further, the present disclosure provides a pharmaceutical composition, comprising any of the anti-Galectin-9 antibodies or a nucleic acid(s) encoding such, and a pharmaceutically acceptable carrier.

In yet another aspect, the present disclosure features a method of inhibiting Galectin-9-mediated cell signaling in a subject, the method comprising administering to a subject in need thereof an effective amount of an anti-Galectin-9 antibody or a pharmaceutical composition comprising an anti-Galectin-9 antibody. In some embodiments, the anti-Galectin-9 antibody is any of the anti-Galectin-9 antibodies disclosed herein or a pharmaceutical composition comprising such. In some embodiments, the subject in need thereof is a human patient having, suspected of having, or at risk for having, an autoimmune disease, a solid cancer, a microbial disease, a hematological malignancy, or an allergic disorder. Exemplary autoimmune diseases include, but are not limited to, a rheumatoid condition (e.g., rheumatoid arthritis), an autoimmune respiratory disease, an autoimmune metabolic and/or endocrine disorder (e.g., type I diabetes), or a fibrotic condition. Exemplary solid tumors include, but are not limited to, pancreatic ductal adenocarcinoma (PDA), colorectal cancer (CRC), melanoma, cholangiocarcinoma, breast cancer, small cell and non small cell lung cancer, upper and lower gastrointestinal malignancies, gastric cancer, squamous cell head and neck cancer, genitourinary cancer, hepatocellular carcinoma, ovarian cancer, sarcomas, mesothelioma, glioblastoma, esophageal cancer, bladder cancer, urothelial cancer, renal cancer, cervical and endometrial cancer. Exemplary hematological malignancies include, but are not limited to, acute lymphoblastic leukemia, chronic lymphocytic leukemia, lymphomas, multiple myeloma, and acute myelogenous leukemia, chronic myelogenous leukemia, myelodysplastic syndromes, or myeloproliferative neoplasms and other myeloproliferative and myelodysplastic disorders. In some examples, the effective amount of the pharmaceutical composition is sufficient to block interaction between Galectin-9 and Dectin-1. In some embodiments, the effective amount of the pharmaceutical composition is sufficient to block interaction between Galectin-9 and CD206. Alternatively, or in addition, but not limited to, the effective amount of the pharmaceutical composition is sufficient to block interaction between Galactin-9 and Tim-3.

Further, the present disclosure provides a method for modifying, eliminating and/or reducing pathologic cells expressing Galectin-9 (e.g., via antibody-dependent cell cytotoxicity or ADCC), the method comprising administering to a subject having pathologic cells expressing Galectin-9 an effective amount of an anti-Galectin-9 antibody, such as any of the anti-Galectin-9 antibodies described herein, or a pharmaceutical composition thereof. In some embodiments, the subject is a human patient having cancer cells expressing Galectin-9 and/or pathologic immune cells expressing Galectin-9. In some embodiments, the effective amount of the pharmaceutical composition is sufficient to initiate antibody-dependent cell cytotoxicity (ADCC) and/or block against pathologic cells expressing Galectin-9.

Any of the treatment methods described herein may further comprise administering to the subject an inhibitor of a checkpoint molecule, an activator of a co-stimulatory receptor, or an inhibitor of an innate immune cell target. Examples of checkpoint molecules include, but are not limited to, PD-1, PD-L1, PD-L2, CTLA-4, LAG3, TIM-3 and A2aR. Examples of co-stimulatory receptors include, but are not limited to, OX40, GITR, CD137, CD40, CD27, and ICOS. Examples of innate immune cell targets include, but are not limited to, KIR, NKG2A, CD96, TLR, and IDO.

The present disclosure also provides pharmaceutical compositions for use in treating a disease associated with Galectin-9 (e.g., those described herein), wherein the pharmaceutical composition comprises an anti-Galectin-9 antibody, such as any of the anti-Galectin-9 antibodies described herein, or a nucleic acid(s) encoding such antibody, and a pharmaceutically acceptable carrier. Also, the present disclosure provides uses of the anti-Galectin-9 antibodies or the encoding nucleic acids for manufacturing a medicament for use in treating the target diseases as described herein.

The details of one or more embodiments of the invention are set forth in the description below. Other features or advantages of the present invention will be apparent from the following drawing and detailed description of several embodiments, and also from the appended claims.

BRIEF DESCRIPTION OF DRAWINGS

The following drawings form part of the present specification and are included to further demonstrate certain aspects of the present disclosure, which can be better understood by reference to the drawing in combination with the detailed description of specific embodiments presented herein.

FIG. 1A: binding to human and mouse Galectin-9 shown by phage ELISA. FIG. 1B: affinity of Fabs clones to Galectin-9 CRD2 determined by competition phage ELISA.

FIGS. 2A-2B include charts showing a binding characterization of Fabs for Galectin-9 CRD1 using phage ELISA. FIG. 2A: binding of Fab clones to human and mouse Galectin-9 CRD1 shown by phage ELISA. FIG. 2B: affinity of Fabs clones to Galectin-9 CRD1 determined by competition phage ELISA.

FIG. 3A: mouse Galectin-9 CRD2-coated wells pre-incubated with purified G9.2-1 or G9.2-3 Fabs prior to addition of phage-displayed Galectin-9 CRD2 binding Fab clones. FIG. 3B: human Galectin-9 CRD2-coated wells pre-incubated with purified G9.2-15 or G9.2-17 Fabs prior to addition of phage-displayed Galectin-9 CRD2 binding Fab clones.

FIG. 7 includes diagrams showing an SPR analysis of G9.2-17 human IgG4 binding to CRD2 of human (top) and mouse (bottom) Galectin-9. The gray lines show the sensorgrams for the non-binding negative control, G9.2-iso human IgG4.

FIG. 10A: A diagram showing the binding activity of G9.2-17 to Galectin-9 CRD2 mutants as determined by phage ELISA. The reduction in ELISA signal indicates a site on the Galectin-9 CRD2 that is critical to G9.2-17 binding. FIG. 10B: a diagram depicting the location of W309 as mapped on the crystal structure of human Galectin-9 CRD2 (PDB ID 3NV2), which is opposite to the binding site of the sugar ligand as mapped on the crystal structure (W309 corresponds with W277 in UniProt ID 000182-2; PDB ID 3NV2).

FIG. 24A depicts a graph showing an ELISA measuring the interaction between immobilized human Galectin-9 and soluble CD206 in the absence and presence of the addition of G9.1-8m13, or G9.2-17 antibody. Isotype antibody wells serves as control. Galectin-9 coated wells were incubated with CD206 with or without G9.1-8m13, G9.2-17, a combination of both antibodies, or an isotype. (Experiments performed in triplicate; *p<0.05; p<0.01; *p<0.001; ****p<0.0001; by unpaired Student's t-test). These results indicate that both G9.1-8m13 and G9.2-17 antibodies inhibit the interaction between Galectin-9 and CD206 and their effects are additive.

DETAILED DESCRIPTION OF INVENTION

Figure 1A:
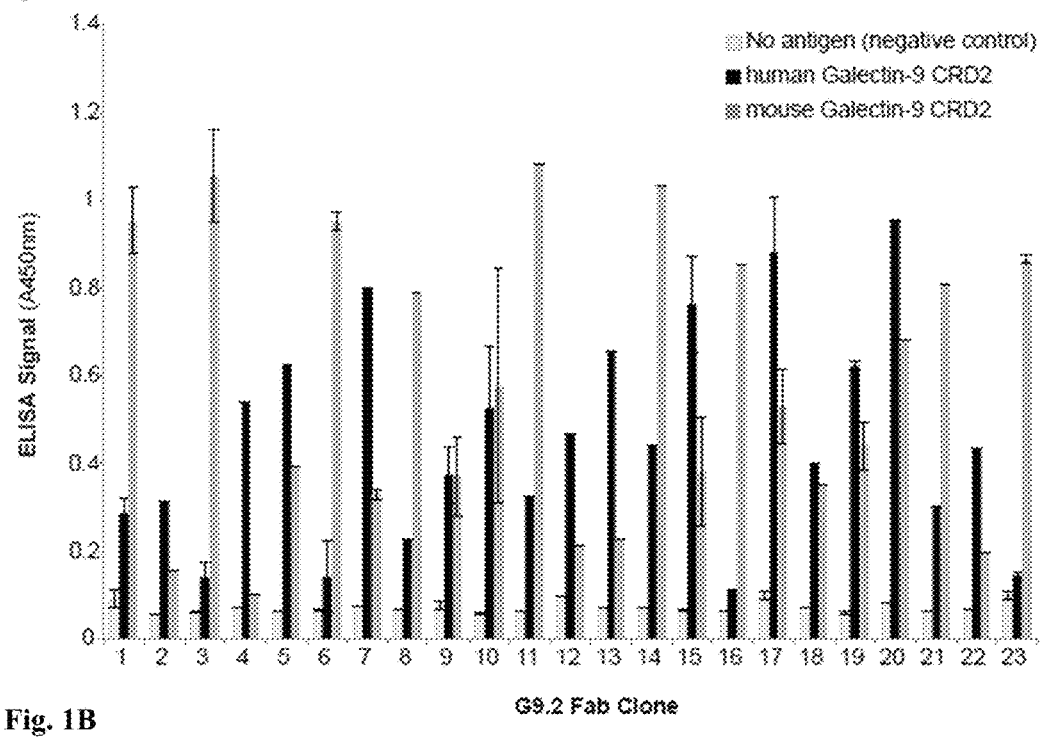
FIGS. 1A-1B include charts showing a binding characterization of Fabs for Galectin-9 CRD2 using phage ELISAs.

Provided herein are antibodies capable of binding to Galectin-9 (e.g., human, mouse, or both). In some embodiments, the anti-Galectin-9 antibodies bind to one or more epitopes in the CRD1 and/or CRD2 domains. Such anti-Galectin-9 antibodies are capable of suppressing the signaling mediated by Galectin-9 (e.g., the signaling pathway mediated by Galectin-9/Dectin-1 or Galectin-9/Tim-3) or eliminating pathologic cells expressing Galectin-9 via, e.g., ADCC. Accordingly, the anti-Galectin-9 antibodies described herein can be used for inhibiting any of the Galectin-9 signaling and/or eliminating Galectin-9 positive pathologic cells, thereby benefiting treatment of diseases associated with Galectin-9, for example, autoimmune diseases, solid tumors, allergic disorders, or hematological disorders such as hematological malignancies.

Galectin-9, a tandem-repeat lectin, is a beta-galactoside-binding protein, which has been shown to have a role in modulating cell-cell and cell-matrix interactions. It is found to be strongly overexpressed in Hodgkin's disease tissue and in other pathologic states. It may also be found circulating in the tumor microenvironment (TME).

Galectin-9 is found to interact with Dectin-1, an innate immune receptor which is highly expressed on macrophages in PDA, as well as on cancer cells (Daley D, et al. Dectin 1 activation on macrophages by galectin 9 promotes pancreatic carcinoma and peritumoral immune tolerance; Nat Med. 2017; 23(5):556-6). Regardless of the source of Galectin-9, disruption of its interaction with Dectin-1 has been shown to lead to the reprogramming of $CD4^+$ and $CD8^+$ cells into indispensable mediators of anti-tumor immunity. Thus, Galectin-9 serves as a valuable therapeutic target for blocking the signaling mediated by Dectin-1. Accordingly, in some embodiments, the anti-Galectin-9 antibodies describe herein disrupt the interaction between Galectin-9 and Dectin-1.

Galectin-9 is also found to interact with TIM-3, a type I cell surface glycoprotein expressed on the surface of leukemic stem cells in all varieties of acute myeloid leukemia (except for M3 (acute promyelocytic leukemia)), but not expressed in normal human hematopoietic stem cells (HSCs). TIM-3 signaling resulting from Galectin-9 ligation has been found to have a pleiotropic effect on immune cells, inducing apoptosis in Th1 cells (Zhu et al., Nat Immunol., 2005, 6:1245-1252) and stimulating the secretion of tumor necrosis factor-α (TNF-α), leading to the maturation of monocytes into dendritic cells, resulting in inflammation by innate immunity (Kuchroo et al., Nat Rev Immunol., 2008, 8:577-580). Further Galectin-9/TIM-3 signaling has been found to co-activate NF-κB and β-catenin signaling, two pathways that promote LSC self-renewal (Kikushige et al., Cell Stem Cell, 2015, 17(3):341-352). An anti-Galectin-9 antibody that interferes with Galectin-9/TIM-3 binding could have a therapeutic effect, especially with respect to leukemia and other hematological malignancies. Accordingly, in some embodiments, the anti-Galectin-9 antibodies described herein disrupt the interaction between Galectin-9 and TIM-3.

Galectin-9 is also found to interact with CD206, a mannose receptor highly expressed on M2 polarized macrophages, thereby promoting tumor survival (Enninga et al., CD206-positive myeloid cells bind galectin-9 and promote a tumor-supportive microenvironment. J Pathol. 2018 August; 245(4):468-477). Tumor-associated macrophages expressing CD206 are mediators of tumor immunosuppression, angiogenesis, metastasis, and relapse (see, e.g., Scodeller et al., Precision Targeting of Tumor Macrophages with a CD206 Binding Peptide. M1 and M2 had been described as the functional states of macrophages; Sci Rep. 2017 Nov. 7; 7(1):14655, and references therein). Specifically, M1 (also termed classically activated macrophages) are trigged by Th1-related cytokines and bacterial products, express high levels of IL-12, and are tumoricidal. By contrast, M2 (so-called alternatively activated macrophages) are activated by Th2-related factors, express high level of anti-inflammatory cytokines, such as IL-10, and facilitate tumor progression (Biswas and Mantovani; Macrophage plasticity and interaction with lymphocyte subsets: cancer as a paradigm; Nat Immunol. 2010 October; 11(10):889-96). The pro-tumoral effects of M2 include the promotion of angiogenesis, advancement of invasion and metastasis, and the protection of the tumor cells from chemotherapy-induced apoptosis (Hu et al., Functional significance of macrophages in pancreatic cancer biology; Tumour Biol. 2015 December; 36(12): 9119-9126, and references therein). Tumor-associated macrophages are thought be of M2-like phenotype and have a protumor role. Galectin-9 has been shown to mediate myeloid cell differentiation toward an M2 phenotype (Enninga et al., Galectin-9 modulates immunity by promoting Th2/M2 differentiation and impacts survival in patients with metastatic melanoma; Melanoma Res. 2016 October; 26(5): 429-41). It is possible that Galectin-9 binding CD206 may result in reprogramming TAMs towards the M2 phenotype, similar to what has been previously shown for Dectin. Without wishing to be bound by theory, blocking the interaction of Galectin-9 with CD206 may provide one mechanism by which an anti-Galectin antibody, e.g., es described herein in Table 1 and Table 2, such as antibody 9.1-8m13 and/or antibody 9.2-17, can be therapeutically beneficial. Accordingly, in some embodiments, the anti-Galectin-9 antibodies described herein disrupt the interaction between Galectin-9 and CD206.

Galectin-9 has also been shown to interact with protein disulfide isomerase (PDI) and 4-1BB (Bi S, et al. Galectin-9 binding to cell surface protein disulfide isomerase regulates the redox environment to enhance T-cell migration and HIV entry; Proc Natl Acad Sci USA. 2011; 108(26):10650-5; Madireddi et al. Galectin-9 controls the therapeutic activity of 4-1BB-targeting antibodies. J Exp Med. 2014; 211(7): 1433-48).

Anti-Galectin-9 antibodies can serve as therapeutic agents for treating diseases associated with Galectin-9 (e.g., those in which a Galectin-9 signaling plays a role). Without being bound by theory, an anti-Galectin-9 antibody may block a signaling pathway mediated by Galectin-9. For example, the antibody may interfere with the interaction between Galectin-9 and its binding partner (e.g., Dectin-1, TIM-3 or CD206), thereby blocking the signaling triggered by the Galectin-9/Ligand interaction. Alternatively, or in addition, an anti-Galectin-9 antibody may also exert its therapeutic effect by inducing blockade and/or cytotoxicity, for example, ADCC, CDC, or ADCP against pathologic cells that express Galectin-9. A pathologic cell refers to a cell that contributes to the initiation and/or development of a disease, either directly or indirectly.

Accordingly, described herein are anti-Galectin-9 antibodies and therapeutic uses thereof for treating diseases associated with Galectin-9.

Antibodies Binding to Galectin-9

The present disclosure provides antibodies that bind Galectin-9, for example, human and/or mouse Galectin-9.

In some instances, the anti-Galectin antibody described herein binds to an epitope in a carbohydrate recognition domain (CRD) of Galectin-9, e.g., CRD1 or CRD2. In some instances, the anti-Galectin antibody may bind to CRD1 and CRD2. Galectin-9 is a protein well known in the art. For example, NCBI GenBank Accession Nos. BAB83625.1 and NP_034838.2 provide information for human and mouse Galectin-1, respectively. Provided herein are exemplary human and mouse Galectin-9 polypeptides; Human galectin-9 (isoform 1; aka "long;") is provided as SEQ ID NO: 1; human CRD1 and CRD2 are provided herein as SEQ ID NO: 3 and SEQ ID NO: 4, respectively; mouse galectin-9 (isoform 1; aka "long;") is provided as SEQ ID NO: 2; human and mouse CRD1 and CRD2 are provided herein as SEQ ID NO: 5 and SEQ ID NO: 6, respectively.

The CRD1 domain of human Galectin-9 (SEQ ID NO: 3) encompasses residues 1-148 of SEQ ID NO:1, and the CRD2 domain (SEQ ID NO: 4) spans residues 218-355 of SEQ ID NO: 1. Similarly, the CRD1 domain of murine Galectin-9 (SEQ ID NO: 5) spans residues 1-147 of SEQ ID NO:2, and the CRD2 domain (SEQ ID NO: 6) spans residues 226-353 of SEQ ID NO: 2.

Galectin-9 polypeptides from other species are known in the art and can be obtained from publicly available gene database, for example, GenBank, using either the human sequence or the mouse sequence as a query. The CRD1 and CRD2 domains of a Galectin-9 polypeptide can be identified by aligning the sequence of that Galectin-9 polypeptide with that of the human or mouse Galectin-9 as described herein.

The antibodies described herein bind Galectin-9 or a fragment thereof (e.g., CRD1 or CRD2). As used herein, the term "anti-Galectin-9 antibody" refers to any antibody capable of binding to a Galectin-9 polypeptide, which can be of a suitable source, for example, human or a non-human mammal (e.g., mouse, rat, rabbit, primate such as monkey, etc.). In some embodiments, the anti-Galectin-9 antibody can be used therapeutically to suppress the bioactivity of Galectin-9. In some embodiments, the anti-Galectin-9 antibody may be used in research or may be used in diagnostic/prognostic methods, e.g., for the detection of cells expressing Galectin-9 in an assessment of treatment eligibility and/or efficacy. Alternatively, or in addition, an anti-Galectin-9 antibody may block the interaction between Galactin-9 and its ligand (e.g., Dectin-1, TIM-3), thereby suppressing the signaling pathway triggered by, for example, the Galactin-9/Dectin-1 or Galectin-9/TIM-3 interaction. An anti-Galectin-9 antibody may also elicit the death of cells expressing Galectin-9, for example, through an antibody-dependent cellular cytotoxicity (ADCC) mechanism.

An antibody (interchangeably used in plural form) is an immunoglobulin molecule capable of specific binding to a target, such as a carbohydrate, polynucleotide, lipid, polypeptide, etc., through at least one antigen recognition site, located in the variable region of the immunoglobulin molecule. As used herein, the term "antibody", e.g., anti- Galectin-9 antibody, encompasses not only intact (e.g., full-length) polyclonal or monoclonal antibodies, but also antigen-binding fragments thereof (such as Fab, Fab', F(ab')2, Fv), single chain (scFv), mutants thereof, fusion proteins comprising an antibody portion, humanized antibodies, chimeric antibodies, diabodies, nanobodies, linear antibodies, single chain antibodies, multispecific antibodies (e.g., bispecific antibodies) and any other modified configuration of the immunoglobulin molecule that comprises an antigen recognition site of the required specificity, including glycosylation variants of antibodies, amino acid sequence variants of antibodies, and covalently modified antibodies. An antibody, e.g., anti-Galectin-9 antibody, includes an antibody of any class, such as IgD, IgE, IgG, IgA, or IgM (or sub-class thereof), and the antibody need not be of any particular class. Depending on the antibody amino acid sequence of the constant domain of its heavy chains, immunoglobulins can be assigned to different classes. There are five major classes of immunoglobulins: IgA, IgD, IgE, IgG, and IgM, and several of these may be further divided into subclasses (isotypes), e.g., IgG1, IgG2, IgG3, IgG4, IgA1 and IgA2. The heavy-chain constant domains that correspond to the different classes of immunoglobulins are called alpha, delta, epsilon, gamma, and mu, respectively. The subunit structures and three-dimensional configurations of different classes of immunoglobulins are well known.

A typical antibody molecule comprises a heavy chain variable region ($V_H$) and a light chain variable region ($V_L$), which are usually involved in antigen binding. The $V_H$ and $V_L$ regions can be further subdivided into regions of hypervariability, also known as "complementarity determining regions" ("CDR"), interspersed with regions that are more conserved, which are known as "framework regions" ("FR"). Each $V_H$ and $V_L$ is typically composed of three CDRs and four FRs, arranged from amino-terminus to carboxy-terminus in the following order: FR1, CDR1, FR2, CDR2, FR3, CDR3, FR4. The extent of the framework region and CDRs can be precisely identified using methodology known in the art, for example, by the Kabat definition, the Chothia definition, the AbM definition, and/or the contact definition, all of which are well known in the art. See, e.g., Kabat, E. A., et al. (1991) *Sequences of Proteins of Immunological Interest, Fifth Edition*, U.S. Department of Health and Human Services, NIH Publication No. 91-3242, Chothia et al., (1989) Nature 342:877; Chothia, C. et al. (1987) J. Mol. Biol. 196:901-917, Al-lazikani et al (1997) J. Molec. Biol. 273:927-948; and Almagro, J. Mol. Recognit. 17:132-143 (2004). See also hgmp.mrc.ac.uk and bioinf.org.uk/abs).

The anti-Galectin-9 antibody described herein may be a full-length antibody, which contains two heavy chains and two light chains, each including a variable domain and a constant domain. Alternatively, the anti-Galectin-9 antibody can be an antigen-binding fragment of a full-length antibody. Examples of binding fragments encompassed within the term "antigen-binding fragment" of a full length antibody include (i) a Fab fragment, a monovalent fragment consisting of the $V_L$, $V_H$, $C_L$ and $C_H1$ domains; (ii) a F(ab')2 fragment, a bivalent fragment including two Fab fragments linked by a disulfide bridge at the hinge region; (iii) a Fd fragment consisting of the $V_H$ and $C_H1$ domains; (iv) a Fv fragment consisting of the $V_L$ and $V_H$ domains of a single arm of an antibody, (v) a dAb fragment (Ward et al., (1989) *Nature* 341:544-546), which consists of a $V_H$ domain; and (vi) an isolated complementarity determining region (CDR) that retains functionality. Furthermore, although the two domains of the Fv fragment, $V_L$ and $V_H$, are coded for by separate genes, they can be joined, using recombinant methods, by a synthetic linker that enables them to be made as a single protein chain in which the $V_L$ and $V_H$ regions pair to form monovalent molecules known as single chain Fv (scFv). See e.g., Bird et al. (1988) *Science* 242:423-426; and Huston et al. (1988) *Proc. Natl. Acad. Sci. USA* 85:5879-5883.

The anti-Galectin-9 antibody as described herein, e.g., in Table 1 and/or Table 2, can bind and inhibit (e.g., reduce or eliminate) the activity of Galectin-9. In some embodiments, the anti-Galectin-9 antibody as described herein can bind and inhibit the activity of Galectin-9 by at least 30% (e.g., 31%, 35%, 40%, 45%, 50%, 60%, 70%, 80%, 90%, 95% or greater, including any increment therein). The apparent inhibition constant ($Ki^{app}$ or $K_{i,app}$), which provides a measure of inhibitor potency, is related to the concentration of inhibitor required to reduce enzyme activity and is not dependent on enzyme concentrations. The inhibitory activity of an anti-Galectin-9 antibody described herein can be determined by routine methods known in the art.

The $K_i^{app}$ value of an antibody may be determined by measuring the inhibitory effect of different concentrations of the antibody on the extent of the reaction (e.g., enzyme activity); fitting the change in pseudo-first order rate constant (v) as a function of inhibitor concentration to the modified Morrison equation (Equation 1) yields an estimate of the apparent Ki value. For a competitive inhibitor, the $Ki^{app}$ can be obtained from the y-intercept extracted from a linear regression analysis of a plot of $K_i^{app}$ versus substrate concentration.

$$v = A \cdot \frac{([E] - [I] - K_i^{app}) + \sqrt{([E] - [I] - K_i^{app})^2 + 4[E] \cdot K_i^{app}}}{2} \quad \text{(Equation 1)}$$

Where A is equivalent to $v_o/E$, the initial velocity ($v_o$) of the enzymatic reaction in the absence of inhibitor (I) divided by the total enzyme concentration (E). In some embodiments, the anti-Galectin-9 antibody described herein may have a $Ki^{app}$ value of 1000, 900, 800, 700, 600, 500, 400, 300, 200, 100, 50, 40, 30, 20, 19, 18, 17, 16, 15, 14, 13, 12, 11, 10, 9, 8, 7, 6, 5 pM or less for the target antigen or antigen epitope. In some embodiments, the anti-Galectin-9 antibody may have a lower $Ki^{app}$ for a first target (e.g., the CRD2 of Galectin-9) relative to a second target (e.g., CRD1 of Galectin-9). Differences in $Ki^{app}$ (e.g., for specificity or other comparisons) can be at least 1.5, 2, 3, 4, 5, 10, 15, 20, 37.5, 50, 70, 80, 91, 100, 500, 1000, 10,000 or $10^5$ fold. In some examples, the anti-Galectin-9 antibody inhibits a first antigen (e.g., a first protein in a first conformation or mimic thereof) greater relative to a second antigen (e.g., the same first protein in a second conformation or mimic thereof; or a second protein). In some embodiments, any of the anti-Galectin-9 antibodies may be further affinity matured to reduce the $Ki^{app}$ of the antibody to the target antigen or antigenic epitope thereof.

In some embodiments, the anti-Galectin-9 antibody suppresses the Dectin-1 signaling, e.g., in tumor infiltrating immune cells, such as macrophages. In some embodiments, the anti-Galectin-9 antibody suppresses the Dectin-1 signaling triggered by Galectin-9 by at least 30% (e.g., 31%, 35%, 40%, 50%, 60%, 70%, 80%, 90%, 95% or greater, including any increment therein). Such inhibitory activity can be determined by conventional methods or the assays described herein, for example, Example 2. Alternatively or in addition, the anti-Galectin-9 antibody may suppress the T cell immunoglobulin mucin-3 (TIM-3) signaling initiated by Galectin-9. In some embodiments, the anti-Galectin-9 antibody suppresses the T cell immunoglobulin mucin-3 (TIM-3) signaling, e.g., in tumor infiltrating immune cells, e.g., in some embodiments by at least 30% (e.g., 31%, 35%, 40%, 50%, 60%, 70%, 80%, 90%, 95% or greater, including any increment therein). Such inhibitory activity can be determined by conventional methods or the assays described herein, for example, Example 2.

In some embodiments, the anti-Galectin-9 antibody suppresses the CD206 signaling, e.g., in tumor infiltrating immune cells. In some embodiments, the anti-Galectin-9 antibody suppresses the CD206 signaling triggered by Galectin-9 by at least 30% (e.g., 31%, 35%, 40%, 50%, 60%, 70%, 80%, 90%, 95% or greater, including any increment therein). Such inhibitory activity can be determined by conventional methods or the assays described herein, for example, Example 13. In some embodiments, the anti-Galectin-9 antibody blocks or prevents binding of Galectin-9 to CD206 by at least 30% (e.g., 31%, 35%, 40%, 50%, 60%, 70%, 80%, 90%, 95% or greater, including any increment therein). Such inhibitory activity can be determined by conventional methods or the assays described herein, for example, Example 13.

In some embodiments, any of the anti-Galectin-9 antibodies described herein induce cell cytotoxicity, such as ADCC, in target cells expressing Galectin-9, e.g., wherein the target cells are cancer cells or immune suppressive immune cells. In some embodiments, the anti-Galectin-9 antibody induces apoptosis in immune cells, such as T cells, or cancer cells by at least 30% (e.g., 31%, 35%, 40%, 50%, 60%, 70%, 80%, 90%, 95% or greater, including any increment therein). Such inhibitory activity can be determined by conventional methods or the assays described herein, for example, Example 14. In some embodiments, any of the anti-Galectin-9 antibodies described herein induce cell cytotoxicity such as complement-dependent cytotoxicity (CDC) against target cells expressing Galectin-9.

Antibody-dependent cell-mediated phagocytosis (ADCP) is an important mechanism of action for antibodies that mediate part or all of their action though phagocytosis. In that case, antibodies mediate uptake of specific antigens by antigen presenting cells. ADCP can be mediated by monocytes, macrophages, neutrophils, and dendritic cells, through FcγRIIa, FcγRI, and FcγRIIIa, of which FcγRIIa (CD32a) on macrophages represent the predominant pathway. In some embodiments, any of the anti-Galectin-9 antibodies described herein induce cell phagocytosis of target cells, e.g., cancer cells or immune suppressive immune cells expressing Galectin-9 (ADCP). In some embodiments, the anti-Galectin-9 antibody increases phagocytosis of target cells, e.g., cancer cells or immune suppressive immune cells, by at least 30% (e.g., 31%, 35%, 40%, 50%, 60%, 70%, 80%, 90%, 95% or greater, including any increment therein).

In some embodiments, any of the anti-Galectin-9 antibodies described herein induce cell cytotoxicity such as complement-dependent cytotoxicity (CDC) against target cells, e.g., cancer cells or immune suppressive immune cells. In some embodiments, the anti-Galectin-9 antibody increases CDC against target cells by at least 30% (e.g., 31%, 35%, 40%, 50%, 60%, 70%, 80%, 90%, 95% or greater, including any increment therein).

In some embodiments, any of the anti-Galectin-9 antibodies described herein induce T cell activation, e.g., in tumor infiltrating T cells, i.e., suppress Galectin-9 mediated inhibition of T cell activation, either directly or indirectly. In some embodiments, the anti-Galectin-9 antibody promotes T cell activation by at least 30% (e.g., 31%, 35%, 40%, 50%, 60%, 70%, 80%, 90%, 95% or greater, including any increment therein). T cell activation can be determined by conventional methods or the assays described herein, for example, Example 6 (e.g., measurement of CD44, OX40, IFNgamma, PD-1). In some embodiments, the anti-Galectin-9 antibody promotes CD4+ cell activation by at least 30% (e.g., 31%, 35%, 40%, 50%, 60%, 70%, 80%, 90%, 95% or greater, including any increment therein). In a non-limiting example, the anti-Galectin antibody induces CD44 expression in CD4+ cells. In some embodiments, the anti-Galectin-9 antibody increases CD44 expression in CD4+ cells by at least 30% (e.g., 31%, 35%, 40%, 50%, 60%, 70%, 80%, 90%, 95% or greater, including any increment therein). In a non-limiting example, the anti-Galectin antibody induces IFNgamma expression in CD4+ cells. In some embodiments, the anti-Galectin-9 antibody increases IFNgamma expression in CD4+ cells by at least 30% (e.g., 31%, 35%, 40%, 50%, 60%, 70%, 80%, 90%, 95% or greater, including any increment therein). In a non-limiting example, the anti-Galectin antibody induces TNFalpha expression in CD4+ cells. In some embodiments, the anti-Galectin-9 antibody increases TNFalpha expression in CD4+ cells by at least 30% (e.g., 31%, 35%, 40%, 50%, 60%, 70%, 80%, 90%, 95% or greater, including any increment therein).

In some embodiments, the anti-Galectin-9 antibody promotes CD8+ cell activation by at least 30% (e.g., 31%, 35%, 40%, 50%, 60%, 70%, 80%, 90%, 95% or greater), including any increment therein). In a non-limiting example, the anti-Galectin antibody induces CD44 expression in CD8+ cells. In some embodiments, the anti-Galectin-9 antibody increases CD44 expression in CD8+ cells by at least 30% (e.g., 31%, 35%, 40%, 50%, 60%, 70%, 80%, 90%, 95% or greater, including any increment therein). In a non-limiting example, the anti-Galectin antibody induces IFNgamma expression in CD8+ cells. In some embodiments, the anti-Galectin-9 antibody increases IFNgamma expression in CD8+ cells by at least 30% (e.g., 31%, 35%, 40%, 50%, 60%, 70%, 80%, 90%, 95% or greater, including any increment therein). In a non-limiting example, the anti-Galectin antibody induces TNFalpha expression in CD8+ cells. In some embodiments, the anti-Galectin-9 antibody increases TNFalpha expression in CD8+ cells by at least 30% (e.g., 31%, 35%, 40%, 50%, 60%, 70%, 80%, 90%, 95% or greater, including any increment therein).

The antibodies described herein can be murine, rat, human, or any other origin (including chimeric or humanized antibodies). Such antibodies are non-naturally occurring, i.e., would not be produced in an animal without human act (e.g., immunizing such an animal with a desired antigen or fragment thereof or isolated from antibody libraries).

Any of the antibodies described herein, e.g., anti-Galectin-9 antibody, can be either monoclonal or polyclonal. A "monoclonal antibody" refers to a homogenous antibody population and a "polyclonal antibody" refers to a heterogeneous antibody population. These two terms do not limit the source of an antibody or the manner in which it is made.

In some embodiments, the anti-Galectin-9 antibody is a humanized antibody. In some embodiments, the anti-Galectin-9 antibody is a humanized antibody having one of more of the elements or characteristics described below or elsewhere herein. Humanized antibodies refer to forms of non-human (e.g., murine) antibodies that are specific chimeric immunoglobulins, immunoglobulin chains, or antigen-binding fragments thereof that contain minimal sequence derived from non-human immunoglobulin. In general, humanized antibodies are human immunoglobulins (recipient antibody) in which residues from a CDR of the recipient are replaced by residues from a CDR of a non-human species (donor antibody) such as mouse, rat, or rabbit having the desired specificity, affinity, and capacity. In some instances, Fv framework region (FR) residues of the human immunoglobulin are replaced by corresponding non-human residues. Furthermore, the humanized antibody may comprise residues that are found neither in the recipient antibody nor in the imported CDR or framework sequences, but are included to further refine and optimize antibody performance. In some instances, the humanized antibody may comprise substantially all of at least one, and typically two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region or domain (Fc), typically that of a human immunoglobulin. Antibodies may have Fc regions modified as described in WO 99/58572. Other forms of humanized antibodies have one or more CDRs (one, two, three, four, five, or six) which are altered with respect to the original antibody, which are also termed one or more CDRs "derived from" one or more CDRs from the original antibody. Humanized antibodies may also involve affinity maturation.

Methods for constructing humanized antibodies are also well known in the art. See, e.g., Queen et al., Proc. Natl. Acad. Sci. USA, 86:10029-10033 (1989). In one example, variable regions of $V_H$ and $V_L$ of a parent non-human antibody are subjected to three-dimensional molecular modeling analysis following methods known in the art. Next, framework amino acid residues predicted to be important for the formation of the correct CDR structures are identified using the same molecular modeling analysis. In parallel, human $V_H$ and $V_L$ chains having amino acid sequences that are homologous to those of the parent non-human antibody are identified from any antibody gene database using the parent $V_H$ and $V_L$ sequences as search queries. Human $V_H$ and $V_L$ acceptor genes are then selected.

The CDR regions within the selected human acceptor genes can be replaced with the CDR regions from the parent non-human antibody or functional variants thereof. When necessary, residues within the framework regions of the parent chain that are predicted to be important in interacting with the CDR regions can be used to substitute for the corresponding residues in the human acceptor genes.

In some embodiments, the anti-Galectin-9 antibody is a chimeric antibody. In some embodiments, the anti-Galectin-9 antibody is a chimeric antibody which may include a heavy constant region and a light constant region from a human antibody. Chimeric antibodies refer to antibodies having a variable region or part of variable region from a first species and a constant region from a second species. Typically, in these chimeric antibodies, the variable region of both light and heavy chains mimics the variable regions of antibodies derived from one species of mammals (e.g., a non-human mammal such as mouse, rabbit, and rat), while the constant portions are homologous to the sequences in antibodies derived from another mammal such as human. In some embodiments, amino acid modifications can be made in the variable region and/or the constant region.

In some embodiments, the anti-Galectin-9 antibodies described herein specifically bind to the corresponding target antigen or an epitope thereof, e.g., Galectin-9 antigen or epitope. An antibody that "specifically binds" to an antigen or an epitope is a term well understood in the art. A molecule is said to exhibit "specific binding" if it reacts more frequently, more rapidly, with greater duration and/or with greater affinity with a particular target antigen than it does with alternative targets. An antibody "specifically binds" to a target antigen or epitope if it binds with greater affinity, avidity, more readily, and/or with greater duration than it binds to other substances. For example, an antibody that specifically (or preferentially) binds to an antigen (Galectin-9) or an antigenic epitope therein is an antibody that binds this target antigen with greater affinity, avidity, more readily, and/or with greater duration than it binds to other antigens or other epitopes in the same antigen. It is also understood with this definition that, for example, an antibody that specifically binds to a first target antigen may or may not specifically or preferentially bind to a second target antigen. As such, "specific binding" or "preferential binding" does not necessarily require (although it can include) exclusive binding. In some examples, an antibody that "specifically binds" to a target antigen or an epitope thereof may not bind to other antigens or other epitopes in the same antigen (i.e., only baseline binding activity can be detected in a conventional method). In some embodiments, the anti-Galectin-9 antibodies described herein specifically bind to Galectin-9. In some embodiments, the anti-Galectin-9 antibodies described herein specifically bind to the CRD2 of Galectin-9. In some embodiments, the anti-Galectin-9 antibodies described herein specifically bind to the CRD1 of Galectin-9. Alternatively, or in addition, the anti-Galectin-9 antibody described herein specifically binds human Galectin-9 or a fragment thereof as relative to the mouse counterpart, or vice versa (e.g., having a binding affinity at least 10-fold higher to one antigen than the other as determined in the same assay under the same assay conditions).

In some embodiments, the anti-Galectin-9 antibody binds only to CRD1 (and not CRD2), for example, meaningful binding to CRD2 or binding to CRD2 is not detectable by a routine assay method. In some embodiments, the anti-Galectin-9 or a fragment thereof binds only to CRD2 (and not CRD1). In some embodiments, certain antibodies described herein may bind to both CRD1 and CRD2. In some embodiments, certain antibodies or fragments thereof described herein may bind to both CRD1 and CRD2, but with a lower affinity to CRD2. In some embodiments, certain antibodies or fragments thereof described herein may bind to both CRD1 and CRD2, but with a lower affinity to CRD1.

In some embodiments, the effect of a CRD1 binding Gal-9 antibody and a CRD2 binding Gal-9 antibody may be additive. In some embodiments, the effect of a CRD1 binding Gal-9 antibody and a CRD2 binding Gal-9 antibody may be synergistic. In some embodiments, a "cocktail" i.e., a mixture of two or more antibodies may be used in a composition. Such compositions may comprise one or more antibodies that bind to CRD1 described herein and one or more antibodies that bind to CRD2 described herein. In a non-limiting example, an antibody comprising the variable region of clone 9.1-8m13 (e.g., SEQ ID NO: 21 (light chain and SEQ ID NO: 86) can be combined with an antibody comprising the variable region of clone 9.2-17 (SEQ ID NO: 54 (light chain and SEQ ID NO: 55) in a composition. Antibodies may be mixed in equimolar amounts or in other ratios, as determined optimal for performance.

In some embodiments, an antibody might bind to both CRD1 and CRD2. In other instances, the anti-Galectin-9 antibody described herein may cross-react to human and a non-human Galectin-9 (e.g., mouse), e.g., the difference in binding affinity to the human and the non-human Galectin-9 is less than 5-fold, e.g., less than 2-fold, or substantially similar.

In some embodiments, an anti-Galectin-9 antibody as described herein has a suitable binding affinity for the target antigen (e.g., Galectin-9) or antigenic epitopes thereof. As used herein, "binding affinity" refers to the apparent association constant or $K_A$. The $K_A$ is the reciprocal of the dissociation constant ($K_D$). The anti-Galectin-9 antibody described herein may have a binding affinity ($K_D$) of at least $10^{-5}$, $10^{-6}$, $10^{-7}$, $10^{-8}$, $10^{-9}$, $10^{-10}$ M, or lower for the target antigen or antigenic epitope. An increased binding affinity corresponds to a decreased $K_D$. Higher affinity binding of an antibody for a first antigen relative to a second antigen can be indicated by a higher $K_A$ (or a smaller numerical value $K_D$) for binding the first antigen than the $K_A$ (or numerical value $K_D$) for binding the second antigen. In such cases, the antibody has specificity for the first antigen (e.g., a first protein in a first conformation or mimic thereof) relative to the second antigen (e.g., the same first protein in a second conformation or mimic thereof; or a second protein). In some embodiments, the anti-Galectin-9 antibodies described herein have a higher binding affinity (a higher $K_A$ or smaller $K_D$) to the CRD1 of Galectin-9 as compared to the binding affinity to the CRD2 of Galectin-9. In some embodiments, the anti-Galectin-9 antibodies described herein have a higher binding affinity (a higher $K_A$ or smaller $K_D$) to the CRD2 of Galectin-9 as compared to the binding affinity to the CRD1 of Galectin-9. Differences in binding affinity (e.g., for specificity or other comparisons) can be at least 1.5, 2, 3, 4, 5, 10, 15, 20, 37.5, 50, 70, 80, 91, 100, 500, 1000, 10,000 or $10^5$ fold. In some embodiments, any of the anti-Galectin-9 antibodies may be further affinity matured to increase the binding affinity of the antibody to the target antigen or antigenic epitope thereof.

Binding affinity (or binding specificity) can be determined by a variety of methods including equilibrium dialysis, equilibrium binding, gel filtration, ELISA, surface plasmon resonance, or spectroscopy (e.g., using a fluorescence assay). Exemplary conditions for evaluating binding affinity are in HBS-P buffer (10 mM HEPES pH7.4, 150 mM NaCl, 0.005% (v/v) Surfactant P20).

These techniques can be used to measure the concentration of bound binding protein as a function of target protein concentration. Under certain conditions, the fractional concentration of bound binding protein ([Bound]/[Total]) is generally related to the concentration of total target protein ([Target]) by the following equation:

[Bound]/[Total]=[Target]/($Kd$+[Target])

It is not always necessary to make an exact determination of $K_A$, though, since sometimes it is sufficient to obtain a quantitative measurement of affinity, e.g., determined using a method such as ELISA or FACS analysis, is proportional to $K_A$, and thus can be used for comparisons, such as determining whether a higher affinity is, e.g., 2-fold higher, to obtain a qualitative measurement of affinity, or to obtain an inference of affinity, e.g., by activity in a functional assay, e.g., an in vitro or in vivo assay. In some cases, the in vitro binding assay is indicative of in vivo activity. In other cases, the in vitro binding assay is not necessarily indicative of in vivo activity. In some cases tight binding is beneficial, but in other cases tight binding may not be as desirable in vivo, and an antibody with lower binding affinity may be more desirable. A number of exemplary anti-Galectin-9 antibodies (specific to CRD1 or CRD2) are provided herein.

Exemplary antibody clones (reference antibodies) of the disclosure binding to CRD1 include G9.1-1, G9.1-2, G9.1-3, G9.1-4, G9.1-5, G9.1-6, G9.1-7, G9.1-8, G9.1-9, G9.1-10, G9.1-11, G9.1-8m1, G9.1-8m2, G9.1-8m3, G9.1-8m4, G9.1-8m5, G9.1-8m6, G9.1-8m7, G9.1- 8m8, G9.1-8m9, G9.1-8m10, G9.1-8m11, G9.1-8m12, G9.1-8m13, and G9.1-8m14. Exemplary antibody clones (reference antibodies) of the disclosure binding to CRD2 include G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, G9.2-26, and G9.2-low affinity binder.

Variable Regions

Exemplary anti-Galectin-9 antibodies described herein binding to CRD1 are antibodies, e.g., monoclonal, recombinant, and/or human antibodies, having the CDR and/or variable region sequences of antibodies G9.1-1, G9.1-2, G9.1-3, G9.1-4, G9.1-5, G9.1-6, G9.1-7, G9.1-8, G9.1-9, G9.1-10, G9.1-11, G9.1-8m1, G9.1-8m2, G9.1-8m3, G9.1-8m4, G9.1-8m5, G9.1-8m6, G9.1-8m7, G9.1-8m8, G9.1-8m9, G9.1-8m10, G9.1-8m11, G9.1-8m12, G9.1-8m13, and G9.1-8m14. Exemplary anti-Galectin-9 antibodies described herein binding to CRD2 are antibodies, e.g., monoclonal, recombinant, and/or human antibodies, having the CDR and/or variable region sequences of antibodies G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, G9.2-26, and G9.2-low affinity binder. Exemplary sequences and SEQ ID NOs are listed in Table 1 and 2. CDRs determined using the Kabat methodology are shown in boldface. Table 3 presents the CDRs, determined with Kabat methodology, of selected clones. Herein the terms "m" and "mut", e.g., "9.1-8m" and "9.1-8mut" are used interchangeably. For example, the "G9.1-8m1", "G9.1-8m2", "G9.1-8m3", "G9.1-8m4", "G9.1-8m5", "G9.1-8m6", "G9.1-8m7", "G9.1-8m8", "G9.1-8m9", "G9.1-8m10", "G9.1-8m11", "G9.1-8m12", "G9.1-8m13", and "G9.1-8m14" are used interchangeably with "G9.1-8mut1", "G9.1-8mut2", "G9.1-8mut3", "G9.1-8mut4", "G9.1-8mut5", "G9.1-8mut6", "G9.1-8mut7", "G9.1-8mut8", "G9.1-8mut9", "G9.1-8mut10", "G9.1-8mut11", "G9.1-8mut12", "G9.1-8mut13", and "G9.1-8mut14, respectively.

TABLE 1

| | | | | | | LC/HC | IgG1 | | IgG4 |
|---|---|---|---|---|---|---|---|---|---|
| Clone | Sequence | | VR | CDR 1 | CDR 2 | CDR 3 | IgG1 SEQ ID NO: | IgG1 LALA | IgG4 | mut |
| | | Antibodies directed against CRD1 | | | | | | | | |
| G9.1-1 | $V_L$: DIQMTQSPSSLSASVGDRV TITCRASQSVSSAVAWYQQKP GKAPKLLIYSASSLYSGVPSRF SGSRSGTDFTLTISSLQPEDFAT YYCQQSWVGSLITFGQGTKV EIKR | | 7 | 328 | 329 | 330 | 88 | 88 | 88 | 88 |

TABLE 1-continued

Antibodies directed against CRD1

| Clone | Sequence | VR | CDR 1 | CDR 2 | CDR 3 | LC/HC IgG1 | IgG1 LALA | IgG4 | IgG4 mut |
|---|---|---|---|---|---|---|---|---|---|
| | | | | | | SEQ ID NO: | | | |
| G9.1-1 | V<sub>H</sub>: EVQLVESGGGLVQPGGSLR LSCAASGFTFSSSSIHWVRQAP GKGLEWVASIYSSYGYTYYA DSVKGRFTISADTSKNTAYLQ MNSLRAEDTAVYYCARYYW GWSQNQGFWWYGLDYWGQ GTLVTVSS | 8 | 431 | 438 | 367 | 116 | 169 | 222 | 275 |
| G9.1-2 | V<sub>L</sub>: DIQMTQSPSSLSASVGDRV TITCRASQSVSSAVAWYQQKP GKAPKLLIYSASSLYSGVPSRF SGSRSGTDFTLTISSLQPEDFAT YYCQQWQWGYSLVTFGQGT KVEIKR | 9 | 328 | 329 | 331 | 89 | 89 | 89 | 89 |
| G9.1-2 | V<sub>H</sub>: EVQLVESGGGLVQPGGSLR LSCAASGFTISSSSIHWVRQAP GKGLEWVASISSYYGSTYYAD SVKGRFTISADTSKNTAYLQM NSLRAEDTAVYYCARSWSSSF WYNWALDYWGQGTLVTVSS | 10 | 435 | 439 | 368 | 117 | 170 | 223 | 276 |
| G9.1-3 | V<sub>L</sub>: DIQMTQSPSSLSASVGDRV TITCRASQSVSSAVAWYQQKP GKAPKLLIYSASSLYSGVPSRF SGSRSGTDFTLTISSLQPEDFAT YYCQQSWYSNKPITFGQGTK VEIKR | 11 | 328 | 329 | 332 | 90 | 90 | 90 | 90 |
| G9.1-3 | V<sub>H</sub>: EVQLVESGGGLVQPGGSLR LSCAASGFTIYSSSIHWVRQAP GKGLEWVAYIYSSSGYTSYAD SVKGRFTISADTSKNTAYLQM NSLRAEDTAVYYCARYSHSSL YYSWIWALDYWGQGTLVTVS S | 12 | 436 | 363 | 369 | 118 | 171 | 224 | 277 |
| G9.1-4 | V<sub>L</sub>: DIQMTQSPSSLSASVGDRV TITCRASQSVSSAVAWYQQKP GKAPKLLIYSASSLYSGVPSRF SGSRSGTDFTLTISSLQPEDFAT YYCQQSSSSLITFGQGTKVEIK R | 13 | 328 | 329 | 333 | 91 | 91 | 91 | 91 |
| G9.1-4 | V<sub>H</sub>: EVQLVESGGGLVQPGGSLR LSCAASGFTIYYSSIHWVRQA PGKGLEWVASISSSSGSTSYA DSVKGRFTISADTSKNTAYLQ MNSLRAEDTAVYYCARSYRP YSSYYWGMDYWGQGTLVTV SS | 14 | 437 | 440 | 370 | 119 | 172 | 225 | 278 |
| G9.1-5 | V<sub>L</sub>: DIQMTQSPSSLSASVGDRV TITCRASQSVSSAVAWYQQKP GKAPKLLIYSASSLYSGVPSRF SGSRSGTDFTLTISSLQPEDFAT YYCQQYYGWFYPVTFGQGT KVEIKR | 15 | 328 | 329 | 334 | 92 | 92 | 92 | 92 |
| G9.1-5 | V<sub>H</sub>: EVQLVESGGGLVQPGGSLR LSCAASGFTIYYSSIHWVRQA PGKGLEWVASISSSYGSTYYA DSVKGRFTISADTSKNTAYLQ MNSLRAEDTAVYYCARSVSW YPYYYYYGYGSGLDYWGQG TLVTVSS | 16 | 437 | 441 | 371 | 120 | 173 | 226 | 279 |
| G9.1-6 | V<sub>L</sub>: DIQMTQSPSSLSASVGDRV TITCRASQSVSSAVAWYQQKP GKAPKLLIYSASSLYSGVPSRF SGSRSGTDFTLTISSLQPEDFAT YYCQQYHSSLFTFGQGTKVEI KR | 17 | 328 | 329 | 335 | 93 | 93 | 93 | 93 |
| G9.1-6 | V<sub>H</sub>: EVQLVESGGGLVQPGGSLR LSCAASGFTLSSSSIHWVRQA PGKGLEWVASIYSSYGSTSYA DSVKGRFTISADTSKNTAYLQ MNSLRAEDTAVYYCARSSHW YMYWSYWGWYIGMDYWGQ GTLVTVSS | 18 | 427 | 442 | 372 | 121 | 174 | 227 | 280 |

TABLE 1-continued

Antibodies directed against CRD1

| Clone | Sequence | VR | CDR 1 | CDR 2 | CDR 3 | LC/HC IgG1 | IgG1 LALA | IgG4 | IgG4 mut |
|---|---|---|---|---|---|---|---|---|---|
| | | | | | | SEQ ID NO: | | | |
| G9.1-7 | V_L: DIQMTQSPSSLSASVGDRV TITCRASQSVSSAVAWYQQKP GKAPKLLIYSASSLYSGVPSRF SGSRSGTDFTLTISSLQPEDFAT YYCQQYPGYRGLITFGQGTK VEIKR | 19 | 328 | 329 | 336 | 94 | 94 | 94 | 94 |
| G9.1-7 | V_H: EVQLVESGGGLVQPGGSLR LSCAASGFTVSSSSIHWVRQA PGKGLEWVASISSYYGYTYYA DSVKGRFTISADTSKNTAYLQ MNSLRAEDTAVYYCARSYSY GYDYFVKYYTMDYWGQGTL VTVSS | 20 | 361 | 443 | 373 | 122 | 175 | 228 | 281 |
| G9.1-8 | V_L: DIQMTQSPSSLSASVGDRV TITCRASQSVSSAVAWYQQKP GKAPKLLIYSASSLYSGVPSRF SGSRSGTDFTLTISSLQPEDFAT YYCQQSYYDSNPITFGQGTKV EIKR | 21 | 328 | 329 | 337 | 95 | 95 | 95 | 95 |
| G9.1-8 | V_H: EVQLVESGGGLVQPGGSLR LSCAASGFTVSSSSIHWVRQA PGKGLEWVAYIYPYSGYTSY ADSVKGRFTISADTSKNTAYL QMNSLRAEDTAVYYCARYST YSWGGIGKWVWGMDYWGQ GTLVTVSS | 22 | 361 | 364 | 374 | 123 | 176 | 229 | 282 |
| G9.1-9 | V_L: DIQMTQSPSSLSASVGDRV TITCRASQSVSSAVAWYQQKP GKAPKLLIYSASSLYSGVPSRF SGSRSGTDFTLTISSLQPEDFAT YYCQQSYFHKIPITFGQGTKV EIKR | 23 | 328 | 329 | 338 | 96 | 96 | 96 | 96 |
| G9.1-9 | V_H: EVQLVESGGGLVQPGGSLR LSCAASGFTVSSSSIHWVRQA PGKGLEWVAYIYSSSGYTSYA DSVKGRFTISADTSKNTAYLQ MNSLRAEDTAVYYCARYSSY HYPYWLFAMDYWGQGTLVT VSS | 24 | 361 | 363 | 384 | 138 | 191 | 244 | 297 |
| G9.1-10 | V_L: DIQMTQSPSSLSASVGDRV TITCRASQSVSSAVAWYQQKP GKAPKLLIYSASSLYSGVPSRF SGSRSGTDFTLTISSLQPEDFAT YYCQQWYWYYPVTFGQGTK VEIKR | 25 | 328 | 329 | 339 | 97 | 97 | 97 | 97 |
| G9.1-10 | V_H: EVQLVESGGGLVQPGGSLR LSCAASGFTVSYSSIHWVRQA PGKGLEWVASIYSYYGSTYYA DSVKGRFTISADTSKNTAYLQ MNSLRAEDTAVYYCARGHYQ EGRKSGFSYWSPALDYWGQ GTLVTVSS | 26 | 429 | 444 | 385 | 139 | 192 | 245 | 298 |
| G9.1-11 | V_L: DIQMTQSPSSLSASVGDRV TITCRASQSVSSAVAWYQQKP GKAPKLLIYSASSLYSGVPSRF SGSRSGTDFTLTISSLQPEDFAT YYCQQTYWGLITFGQGTKVE IKR | 27 | 328 | 329 | 340 | 98 | 98 | 98 | 98 |
| G9.1-11 | V_H: EVQLVESGGGLVQPGGSLR LSCAASGFTVYSSSIHWVRQA PGKGLEWVASIYSYYGYTSYA DSVKGRFTISADTSKNTAYLQ MNSLRAEDTAVYYCARSTEG YDRWGYYSSYWSSGLDYWG QGTLVTVSS | 28 | 428 | 445 | 386 | 140 | 193 | 246 | 299 |
| G9.1-8m1 | V_L: DIQMTQSPSSLSASVGDRV TITCRASQSVSSAVAWYQQKP GKAPKLLIYSASSLYSGVPSRF SGSRSGTDFTLTISSLQPEDFAT YYCQQSYYDSNPITFGQGTKV EIKR | 21 | 328 | 329 | 337 | 95 | 95 | 95 | 95 |

TABLE 1-continued

Antibodies directed against CRD1

| Clone | Sequence | VR | CDR 1 | CDR 2 | CDR 3 | LC/HC IgG1 SEQ ID NO: | IgG1 LALA | IgG4 | IgG4 mut |
|---|---|---|---|---|---|---|---|---|---|
| G9.1-8m1 | V$_H$: EVQLVESGGGLVQPGGSLR LSCAASGFTVSSSSIHWVRQA PGKGLEWVASSSSSSGYTSYA DSVKGRFTISADTSKNTAYLQ MNSLRAEDTAVYYCARYSTY SWGGIGKWVWGMDYWGQG TLVTVSS | 74 | 361 | 365 | 374 | 124 | 177 | 230 | 283 |
| G9.1-8m2 | V$_L$: DIQMTQSPSSLSASVGDRV TITCRASQSVSSAVAWYQQKP GKAPKLLIYSASSLYSGVPSRF SGSRSGTDFTLTISSLQPEDFAT YYCQQSYYDSNPITFGQGTKV EIKR | 21 | 328 | 329 | 337 | 95 | 95 | 95 | 95 |
| G9.1-8m2 | V$_H$: EVQLVESGGGLVQPGGSLR LSCAASGFTVSSSSIHWVRQA PGKGLEWVAYIYPYSSSSSYA DSVKGRFTISADTSKNTAYLQ MNSLRAEDTAVYYCARYSTY SWGGIGKWVWGMDYWGQG TLVTVSS | 75 | 361 | 366 | 374 | 125 | 178 | 231 | 284 |
| G9.1-8m3 | V$_L$: DIQMTQSPSSLSASVGDRV TITCRASQSVSSAVAWYQQKP GKAPKLLIYSASSLYSGVPSRF SGSRSGTDFTLTISSLQPEDFAT YYCQQSYYDSNPITFGQGTKV EIKR | 21 | 328 | 329 | 337 | 95 | 95 | 95 | 95 |
| G9.1-8m3 | V$_H$: EVQLVESGGGLVQPGGSLR LSCAASGFTVSSSSIHWVRQA PGKGLEWVAYIYPYSGYTSY ADSVKGRFTISADTSKNTAYL QMNSLRAEDTAVYYCARSSSS SWGGIGKWVWGMDYWGQG TLVTVSS | 76 | 361 | 364 | 375 | 126 | 179 | 232 | 285 |
| G9.1-8m4 | V$_L$: DIQMTQSPSSLSASVGDRV TITCRASQSVSSAVAWYQQKP GKAPKLLIYSASSLYSGVPSRF SGSRSGTDFTLTISSLQPEDFAT YYCQQSYYDSNPITFGQGTKV EIKR | 21 | 328 | 329 | 337 | 95 | 95 | 95 | 95 |
| G9.1-8m4 | V$_H$: EVQLVESGGGLVQPGGSLR LSCAASGFTVSSSSIHWVRQA PGKGLEWVAYIYPYSGYTSY ADSVKGRFTI SADTSKNTAYL QMNSLRAEDTAVYYCARYST YSSSSSSKWVWGMDYWGQG TLVTVSS | 77 | 361 | 364 | 376 | 127 | 180 | 233 | 286 |
| G9.1-8m5 | V$_L$: DIQMTQSPSSLSASVGDRV TITCRASQSVSSAVAWYQQKP GKAPKLLIYSASSLYSGVPSRF SGSRSGTDFTLTISSLQPEDFAT YYCQQSYYDSNPITFGQGTKV EIKR | 21 | 328 | 329 | 337 | 95 | 95 | 95 | 95 |
| G9.1-8m5 | V$_H$: EVQLVESGGGLVQPGGSLR LSCAASGFTVSSSSIHWVRQA PGKGLEWVAYIYPYSGYTSY ADSVKGRFTISADTSKNTAYL QMNSLRAEDTAVYYCARYST YSWGGIGSSSSSMDYWGQGT LVTVSS | 78 | 361 | 364 | 377 | 128 | 181 | 234 | 287 |
| G9.1-8m6 | V$_L$: DIQMTQSPSSLSASVGDRV TITCRASQSVSSAVAWYQQKP GKAPKLLIYSASSLYSGVPSRF SGSRSGTDFTLTISSLQPEDFAT YYCQQSYYDSNPITFGQGTKV EIKR | 21 | 328 | 329 | 337 | 95 | 95 | 95 | 95 |
| G9.1-8m6 | V$_H$: EVQLVESGGGLVQPGGSLR LSCAASGFTVSSSSIHWVRQA PGKGLEWVAYIYPYSGYTSY ADSVKGRFTISADTSKNTAYL QMNSLRAEDTAVYYCARYST YSSSSSKWVWGMDYWGQGT LVTVSS | 79 | 361 | 364 | 378 | 129 | 182 | 235 | 288 |

TABLE 1-continued

Antibodies directed against CRD1

| Clone | Sequence | VR | CDR 1 | CDR 2 | CDR 3 | LC/HC IgG1 | IgG1 LALA | IgG4 | IgG4 mut |
|---|---|---|---|---|---|---|---|---|---|
| | | | | | SEQ ID NO: | | | | |
| G9.1-8m7 | V$_L$: DIQMTQSPSSLSASVGDRV TITCRASQSVSSAVAWYQQKP GKAPKLLIYSASSLYSGVPSRF SGSRSGTDFTLTISSLQPEDFAT YYCQQSYYDSNPITFGQGTKV EIKR | 21 | 328 | 329 | 337 | 95 | 95 | 95 | 95 |
| G9.1-8m7 | V$_H$: EVQLVESGGGLVQPGGSLR LSCAASGFTVSSSSIHWVRQA PGKGLEWVAYIYPYSGYTSY ADSVKGRFTISADTSKNTAYL QMNSLRAEDTAVYYCARYST YSSSSSKWVWGMDYWGQGTL VTVSS | 80 | 361 | 364 | 379 | 130 | 183 | 236 | 289 |
| G9.1-8m8 | V$_L$: DIQMTQSPSSLSASVGDRV TITCRASQSVSSAVAWYQQKP GKAPKLLIYSASSLYSGVPSRF SGSRSGTDFTLTISSLQPEDFAT YYCQQSYYDSNPITFGQGTKV EIKR | 21 | 328 | 329 | f337 | 95 | 95 | 95 | 95 |
| G9.1-8m8 | V$_H$: EVQLVESGGGLVQPGGSLR LSCAASGFTVSSSSIHWVRQA PGKGLEWVAYIYPYSGYTSY ADSVKGRFTISADTSKNTAYL QMNSLRAEDTAVYYCARYST YSSSKWVWGMDYWGQGTLV TVSS | 81 | 361 | 364 | 380 | 131 | 184 | 237 | 290 |
| G9.1-8m9 | V$_L$: DIQMTQSPSSLSASVGDRV TITCRASQSVSSAVAWYQQKP GKAPKLLIYSASSLYSGVPSRF SGSRSGTDFTLTISSLQPEDFAT YYCQQSYYDSNPITFGQGTKV EIKR | 21 | 328 | 329 | 337 | 95 | 95 | 95 | 95 |
| G9.1-8m9 | V$_H$: EVQLVESGGGLVQPGGSLR LSCAASGFTVSSSSIHWVRQA PGKGLEWVAYIYPYSGYTSY ADSVKGRFTISADTSKNTAYL QMNSLRAEDTAVYYCARYST YSSKWVWGMDYWGQGTLVT VSS | 82 | 361 | 364 | 383 | 132 | 185 | 238 | 291 |
| G9.1-8m10 | V$_L$: DIQMTQSPSSLSASVGDRV TITCRASQSVSSAVAWYQQKP GKAPKLLIYSASSLYSGVPSRF SGSRSGTDFTLTISSLQPEDFAT YYCQQSYYDSNPITFGQGTKV EIKR | 21 | 328 | 329 | 337 | 95 | 95 | 95 | 95 |
| G9.1-8m10 | V$_H$: EVQLVESGGGLVQPGGSLR LSCAASGFTVSSSSIHWVRQA PGKGLEWVAYIYPYSGYTSY ADSVKGRFTISADTSKNTAYL QMNSLRAEDTAVYYCARYST YSKWVWGMDYWGQGTLVT VSS | 83 | 361 | 364 | 381 | 133 | 186 | 239 | 292 |
| G9.1-8m11 | V$_L$: DIQMTQSPSSLSASVGDRV TITCRASQSVSSAVAWYQQKP GKAPKLLIYSASSLYSGVPSRF SGSRSGTDFTLTISSLQPEDFAT YYCQQSYYDSNPITFGQGTKV EIKR | 21 | 328 | 329 | 337 | 95 | 95 | 95 | 95 |
| G9.1-8m11 | V$_H$: EVQLVESGGGLVQPGGSLR LSCAASGFTVSSSSIHWVRQA PGKGLEWVAYIYPYSGYTSY ADSVKGRFTISADTSKNTAYL QMNSLRAEDTAVYYCARYST YKWVWGMDYWGQGTLVTV SS | 84 | 361 | 364 | 382 | 134 | 187 | 240 | 293 |
| G9.1-8m12 | V$_L$: DIQMTQSPSSLSASVGDRV TITCRASQSVSSAVAWYQQKP GKAPKLLIYSASSLYSGVPSRF SGSRSGTDFTLTISSLQPEDFAT YYCQQSYYDSNPITFGQGTKV EIKR | 21 | 328 | 329 | 337 | 95 | 95 | 95 | 95 |

TABLE 1-continued

Antibodies directed against CRD1

| Clone | Sequence | VR | CDR 1 | CDR 2 | CDR 3 | LC/HC IgG1 | IgG1 LALA | IgG4 | IgG4 mut |
|---|---|---|---|---|---|---|---|---|---|
| | | | | | SEQ ID NO: | | | | |
| G9.1-8m12 | V$_H$: EVQLVESGGGLVQPGGSLRLSCAASGFTVSSSSIHWVRQAPGKGLEWVAYIYPYSSSSSYADSVKGRFTISADTSKNTAYLQMNSLRAEDTAVYYCARYSTYSSSKWVWGMDYWGQGTLVTVSS | 85 | 361 | 366 | 380 | 135 | 188 | 241 | 294 |
| G9.1-8m13 | V$_L$: DIQMTQSPSSLSASVGDRVTITCRASQSVSSAVAWYQQKPGKAPKLLIYSASSLYSGVPSRFSGSRSGTDFTLTISSLQPEDFATYYCQQSYYDSNPITFGQGTKVEIKR | 21 | 328 | 329 | 337 | 95 | 95 | 95 | 95 |
| G9.1-8m13 | V$_H$: EVQLVESGGGLVQPGGSLRLSCAASGFTVSSSSIHWVRQAPGKGLEWVAYIYPYSSSSSYADSVKGRFTISADTSKNTAYLQMNSLRAEDTAVYYCARYSTYSSKWVWGMDYWGQGTLVTVSS | 86 | 361 | 366 | 383 | 136 | 189 | 242 | 295 |
| G9.1-8m14 | V$_L$: DIQMTQSPSSLSASVGDRVTITCRASQSVSSAVAWYQQKPGKAPKLLIYSASSLYSGVPSRFSGSRSGTDFTLTISSLQPEDFATYYCQQSYYDSNPITFGQGTKVEIKR | 21 | 328 | 329 | 337 | 95 | 95 | 95 | 95 |
| G9.1-8m14 | V$_H$: EVQLVESGGGLVQPGGSLRLSCAASGFTVSSSSIHWVRQAPGKGLEWVAYIYPYSSSSSYADSVKGRFTISADTSKNTAYLQMNSLRAEDTAVYYCARYSTYKWVWGMDYWGQGTLVTVSS | 87 | 361 | 366 | 382 | 137 | 190 | 243 | 296 |

TABLE 2

Antibodies directed against CRD2

| Clone | Sequence | VR | CDR 1 | CDR 2 | CDR 3 | LC/HC IgG1 | IgG1 LALA | IgG4 | IgG4 mut |
|---|---|---|---|---|---|---|---|---|---|
| | | | | | SEQ ID NO: | | | | |
| G9.2-1 | V$_L$: DIQMTQSPSSLSASVGDRVTITCRASQSVSSAVAWYQQKPGKAPKLLIYSASSLYSGVPSRFSGSRSGTDFTLTISSLQPEDFATYYCQQYKSKYPFTFGQGTKVEIKR | 29 | 328 | 329 | 341 | 99 | 99 | 99 | 99 |
| G9.2-1 | V$_H$: EVQLVESGGGLVQPGGSLRLSCAASGFTLYSSSIHWVRQAPGKGLEWVASIYSSSGYTYYADSVKGRFTISADTSKNTAYLQMNSLRAEDTAVYYCARTYTWKSSWSYQTGYGLDYWGQGTLVTVSS | 30 | 424 | 446 | 390 | 141 | 194 | 247 | 300 |
| G9.2-2 | V$_L$: DIQMTQSPSSLSASVGDRVTITCRASQSVSSAVAWYQQKPGKAPKLLIYSASSLYSGVPSRFSGSRSGTDFTLTISSLQPEDFATYYCQQSSSSLITFGQGTKVEIKR | 13 | 328 | 329 | 333 | 91 | 91 | 91 | 91 |
| G9.2-2 | V$_H$: EVQLVESGGGLVQPGGSLRLSCAASGFTFSSSSIHWVRQAPGKGLEWVASISPYYGSTYYADSVKGRFTISADTSKNTAYLQMNSLRAEDTAVYYCARAVYYYVYNRSWYWWSGGFDYWGQGTLVTVSS | 31 | 431 | 447 | 391 | 142 | 195 | 248 | 301 |
| G9.2-3 | V$_L$: DIQMTQSPSSLSASVGDRVTITCRASQSVSSAVAWYQQKPGKAPKLLIYSASSLYSGVPSRFSGSRSGTDFTLTISSLQPEDFATYYCQQSSSSLITFGQGTKVEIKR | 13 | 328 | 329 | 333 | 91 | 91 | 91 | 91 |

TABLE 2-continued

Antibodies directed against CRD2

| Clone | Sequence | VR | CDR 1 | CDR 2 | CDR 3 | LC/HC IgG1 | IgG1 LALA | IgG4 | IgG4 mut |
|---|---|---|---|---|---|---|---|---|---|
| | | | | | | SEQ ID NO: | | | |
| G9.2-3 | V$_H$: EVQLVESGGGLVQPGGSLR LSCAASGFTFSSSSIHWVRQAP GKGLEWVASISSSSGSTSYADS VKGRFTISADTSKNTAYLQMNS LRAEDTAVYYCARPAYSYPYY YFHYGAMDYWGQGTLVTVSS | 32 | 431 | 448 | 392 | 143 | 196 | 249 | 302 |
| G9.2-4 | V$_L$: DIQMTQSPSSLSASVGDRVTI TCRASQSVSSAVAWYQQKPGK APKLLIYSASSLYSGVPSRFSGS RSGTDFTLTISSLQPEDFATYYC QQSSSSLITFGQGTKVEIKR | 13 | 328 | 329 | 342 | 91 | 91 | 91 | 91 |
| G9.2-4 | V$_H$: EVQLVESGGGLVQPGGSLR LSCAASGFTFSSSSIHWVRQAP GKGLEWVASIYPSYGYTSYAD SVKGRFTISADTSKNTAYLQMN SLRAEDTAVYYCARAWYHHE YWGHYSGMDYWGQGTLVTVS S | 33 | 431 | 449 | 393 | 144 | 197 | 250 | 303 |
| G9.2-5 | V$_L$: DIQMTQSPSSLSASVGDRVTI TCRASQSVSSAVAWYQQKPGK APKLLIYSASSLYSGVPSRFSGS RSGTDFTLTISSLQPEDFATYYC QQSSWGLITFGQGTKVEIKR | 34 | 328 | 329 | 343 | 100 | 100 | 100 | 100 |
| G9.2-5 | V$_H$: EVQLVESGGGLVQPGGSLR LSCAASGFTFSSSSIHWVRQAP GKGLEWVASIYSSYGSTYYAD SVKGRFTISADTSKNTAYLQMN SLRAEDTAVYYCARSGYSHPY YSYYSGMDYWGQGTLVTVSS | 35 | 431 | 450 | 394 | 145 | 198 | 251 | 304 |
| G9.2-6 | V$_L$: DIQMTQSPSSLSASVGDRVTI TCRASQSVSSAVAWYQQKPGK APKLLIYSASSLYSGVPSRFSGS RSGTDFTLTISSLQPEDFATYYC QQFWGSKLFTFGQGTKVEIKR | 36 | 328 | 329 | 344 | 101 | 101 | 101 | 101 |
| G9.2-6 | V$_H$: EVQLVESGGGLVQPGGSLR LSCAASGFTFSSSSIHWVRQAP GKGLEWVASIYSYSGYTYYAD SVKGRFTISADTSKNTAYLQMN SLRAEDTAVYYCARTYMAGY KYYFISGYGFDYWGQGTLVTV SS | 37 | 431 | 451 | 395 | 146 | 199 | 252 | 305 |
| G9.2-7 | V$_L$: DIQMTQSPSSLSASVGDRVTI TCRASQSVSSAVAWYQQKPGK APKLLIYSASSLYSGVPSRFSGS RSGTDFTLTISSLQPEDFATYYC QQMYYPGYLITFGQGTKVEIK R | 38 | 328 | 329 | 345 | 102 | 102 | 102 | 102 |
| G9.2-7 | V$_H$: EVQLVESGGGLVQPGGSLR LSCAASGFTFSYSSIHWVRQAP GKGLEWVASIYPSYGYTYYAD SVKGRFTISADTSKNTAYLQMN SLRAEDTAVYYCARYWDYGW MYFDPAMDYWGQGTLVTVSS | 39 | 425 | 452 | 396 | 147 | 200 | 253 | 306 |
| G9.2-8 | V$_L$: DIQMTQSPSSLSASVGDRVTI TCRASQSVSSAVAWYQQKPGK APKLLIYSASSLYSGVPSRFSGS RSGTDFTLTISSLQPEDFATYYC QQDRWWSALTFGQGTKVEIK R | 40 | 328 | 329 | 346 | 103 | 103 | 103 | 103 |
| G9.2-8 | V$_H$: EVQLVESGGGLVQPGGSLR LSCAASGFTFSYSSIHWVRQAP GKGLEWVASIYSYSGYTSYAD SVKGRFTISADTSKNTAYLQMN SLRAEDTAVYYCARYMENWE WPYHSAMDYWGQGTLVTVSS | 41 | 425 | 453 | 397 | 148 | 201 | 254 | 307 |
| G9.2-9 | V$_L$: DIQMTQSPSSLSASVGDRVTI TCRASQSVSSAVAWYQQKPGK APKLLIYSASSLYSGVPSRFSGS RSGTDFTLTISSLQPEDFATYYC QQSYGSWYPITFGQGTKVEIKR | 42 | 328 | 329 | 347 | 104 | 104 | 104 | 104 |

TABLE 2-continued

Antibodies directed against CRD2

| Clone | Sequence | VR | CDR 1 | CDR 2 | CDR 3 | LC/HC IgG1 SEQ ID NO: | IgG1 LALA | IgG4 | IgG4 mut |
|---|---|---|---|---|---|---|---|---|---|
| G9.2-9 | V$_H$: EVQLVESGGGLVQPGGSLR LSCAASGFTFYSSSIHWVRQAP GKGLEWVASIYSSYGSTYYAD SVKGRFTISADTSKNTAYLQMN SLRAEDTAVYYCARSWWYPY WQYYPGGWHSSGFDYWGQG TLVTVSS | 43 | 426 | 454 | 398 | 149 | 202 | 255 | 308 |
| G9.2-10 | V$_L$: DIQMTQSPSSLSASVGDRVTI TCRASQSVSSAVAWYQQKPGK APKLLIYSASSLYSGVPSRFSGS RSGTDFTLTISSLQPEDFATYYC QQGWYASPITFGQGTKVEIKR | 44 | 328 | 329 | 348 | 105 | 105 | 105 | 105 |
| G9.2-10 | V$_H$: EVQLVESGGGLVQPGGSLR LSCAASGFTFYSSSIHWVRQAP GKGLEWVAYISPSSGYTSYADS VKGRFTISADTSKNTAYLQMNS LRAEDTAVYYCARYTMTYQY YPSGAMDYWGQGTLVTVSS | 45 | 426 | 387 | 399 | 150 | 203 | 256 | 309 |
| G9.2-11 | V$_L$: DIQMTQSPSSLSASVGDRVTI TCRASQSVSSAVAWYQQKPGK APKLLIYSASSLYSGVPSRFSGS RSGTDFTLTISSLQPEDFATYYC QQYSSHKYPFTFGQGTKVEIKR | 46 | 328 | 329 | 349 | 106 | 106 | 106 | 106 |
| G9.2-11 | V$_H$: EVQLVESGGGLVQPGGSLR LSCAASGFTIYSSYIHWVRQAP GKGLEWVASIYSSSGYTYYAD SVKGRFTISADTSKNTAYLQMN SLRAEDTAVYYCARSYIYYMW QYNYGMSGYGLDYWGQGTLV TVSS | 47 | 432 | 455 | 400 | 151 | 204 | 257 | 310 |
| G9.2-12 | V$_L$: DIQMTQSPSSLSASVGDRVTI TCRASQSVSSAVAWYQQKPGK APKLLIYSASSLYSGVPSRFSGS RSGTDFTLTISSLQPEDFATYYC QQWVYPGSLITFGQGTKVEIK R | 48 | 328 | 329 | 350 | 107 | 107 | 107 | 107 |
| G9.2-12 | V$_H$: EVQLVESGGGLVQPGGSLR LCAASGFTLSYSSIHWVRQAP GKGLEWVASISSSYGYTYYAD SVKGRFTISADTSKNTAYLQMN SLRAEDTAVYYCARHSPYYLH SWWWSGLDYWGQGTLVTVSS | 49 | 433 | 456 | 401 | 152 | 205 | 258 | 311 |
| G9.2-13 | V$_L$: DIQMTQSPSSLSASVGDRVTI TCRASQSVSSAVAWYQQKPGK APKLLIYSASSLYSGVPSRFSGS RSGTDFTLTISSLQPEDFATYYC QQYKSKYPFTFGQGTKVEIKR | 29 | 328 | 329 | 341 | 99 | 99 | 99 | 99 |
| G9.2-13 | V$_H$: EVQLVESGGGLVQPGGSLR LSCAASGFTLYYSSIHWVRQAP GKGLEWVASISPSYGSTSYADS VKGRFTISADTSKNTAYLQMNS LRAEDTAVYYCARHSWYYPY YYYALDYWGQGTLVTVSS | 50 | 434 | 362 | 402 | 153 | 206 | 259 | 312 |
| G9.2-14 | V$_L$: DIQMTQSPSSLSASVGDRVTI TCRASQSVSSAVAWYQQKPGK APKLLIYSASSLYSGVPSRFSGS RSGTDFTLTISSLQPEDFATYYC QQSSSSLITFGQGTKVEIKR | 13 | 328 | 329 | 333 | 91 | 91 | 91 | 91 |
| G9.2-14 | V$_H$: EVQLVESGGGLVQPGGSLR LSCAASGFTVSSSSIHWVRQAP GKGLEWVASISSSSGYTYYADS VKGRFTISADTSKNTAYLQMNS LRAEDTAVYYCARYWSYPYVY FLAFDYWGQGTLVTVSS | 51 | 361 | 457 | 403 | 154 | 207 | 260 | 313 |
| G9.2-15 | V$_L$: DIQMTQSPSSLSASVGDRVTI TCRASQSVSSAVAWYQQKPGK APKLLIYSASSLYSGVPSRFSGS RSGTDFTLTISSLQPEDFATYYC QQSSWGLITFGQGTKVEIKR | 34 | 328 | 329 | 343 | 100 | 100 | 100 | 100 |

TABLE 2-continued

Antibodies directed against CRD2

| Clone | Sequence | VR | CDR 1 | CDR 2 | CDR 3 | LC/HC IgG1 | IgG1 LALA | IgG4 | IgG4 mut |
|---|---|---|---|---|---|---|---|---|---|
| | | | | | SEQ ID NO: | | | | |
| G9.2-15 | V$_H$: EVQLVESGGGLVQPGGSLR LSCAASGFTVSSSSIHWVRQAP GKGLEWVASIYSSSGYTSYADS VKGRFTISADTSKNTAYLQMNS LRAEDTAVYYCARNVENYPY WAWPWGYYGAIDYWGQGTL VTVSS | 52 | 361 | 458 | 404 | 155 | 208 | 261 | 314 |
| G9.2-16 | V$_L$: DIQMTQSPSSLSASVGDRVTI TCRASQSVSSAVAWYQQKPGK APKLLIYSASSLYSGVPSRFSGS RSGTDFTLTISSLQPEDFATYYC QQSSSSLITFGQGTKVEIKR | 13 | 328 | 329 | 333 | 91 | 91 | 91 | 91 |
| G9.2-16 | V$_H$: EVQLVESGGGLVQPGGSLR LSCAASGFTVSSSSIHWVRQAP GKGLEWVASIYSSSGYTYYAD SVKGRFTISADTSKNTAYLQMN SLRAEDTAVYYCARTYKWSYY TGYGFDYWGQGTLVTVSS | 53 | 361 | 459 | 405 | 156 | 209 | 262 | 315 |
| G9.2-17 | V$_L$: DIQMTQSPSSLSASVGDRVTI TCRASQSVSSAVAWYQQKPGK APKLLIYSASSLYSGVPSRFSGS RSGTDFTLTISSLQPEDFATYYC QQSSTDPITFGQGTKVEIKR | 54 | 328 | 329 | 352 | 108 | 108 | 108 | 108 |
| G9.2-17 | V$_H$: EVQLVESGGGLVQPGGSLR LSCAASGFTVSSSSIHWVRQAP GKGLEWVAYISSSSGYTYYAD SVKGRFTISADTSKNTAYLQMN SLRAEDTAVYYCARYWSYPSW WPYRGMDYWGQGTLVTVSS | 55 | 361 | 388 | 406 | 157 | 210 | 263 | 316 |
| G9.2-17mut6 | V$_L$: DIQMTQSPSSLSASVGDRVTI TCRASQSVSSAVAWYQQKPGK APKLLIYSASSLYSGVPSRFSGS RSGTDFTLTISSLQPEDFATYYC QQSSTDPITFGQGTKVEIKR | 54 | 328 | 329 | 352 | 108 | 108 | 108 | 108 |
| G9.2-17mut6 (mutation is underlined) | V$_H$: EVQLVESGGGLVQPGGSLR LSCAASGFTVSSSSIHWVRQAP GKGLEWVAYISSSSGYTYYAD SVKGRFTISADTSKNTAYLQMN SLRAEDTAVYYCARYWSYPSW SPYRGMDYWGQGTLVTVSS | 56 | 361 | 388 | 407 | 158 | 211 | 264 | 317 |
| G9.2-18 | V$_L$: DIQMTQSPSSLSASVGDRVTI TCRASQSVSSAVAWYQQKPGK APKLLIYSASSLYSGVPSRFSGS RSGTDFTLTISSLQPEDFATYYC QQSSSSLITFGQGTKVEIKR | 13 | 328 | 329 | 333 | 91 | 91 | 91 | 91 |
| G9.2-18 | V$_H$: EVQLVESGGGLVQPGGSLR LSCAASGFTVSSYSIHWVRQAP GKGLEWVAYIYSSSGYTSYAD SVKGRFTISADTSKNTAYLQMN SLRAEDTAVYYCARVGYYYPY LYLGDGLDYWGQGTLVTVSS | 57 | 430 | 363 | 408 | 159 | 212 | 265 | 318 |
| G9.2-19 | V$_L$: DIQMTQSPSSLSASVGDRVTI TCRASQSVSSAVAWYQQKPGK APKLLIYSASSLYSGVPSRFSGS RSGTDFTLTISSLQPEDFATYYC QQSSQYDLITFGQGTKVEIKR | 58 | 328 | 329 | 354 | 109 | 109 | 109 | 109 |
| G9.2-19 | V$_H$: EVQLVESGGGLVQPGGSLR LSCAASGFTVSSYSIHWVRQAP GKGLEWVASISSSSGSTSYADS VKGRFTISADTSKNTAYLQMNS LRAEDTAVYYCARNAWHYEPS YWYGNYATYGFDYWGQGTLV TVSS | 59 | 430 | 460 | 409 | 160 | 213 | 266 | 319 |
| G9.2-20 | V$_L$: DIQMTQSPSSLSASVGDRVTI TCRASQSVSSAVAWYQQKPGK APKLLIYSASSLYSGVPSRFSGS RSGTDFTLTISSLQPEDFATYYC QQSSTDPITFGQGTKVEIKR | 54 | 328 | 329 | 352 | 108 | 108 | 108 | 108 |
| G9.2-20 | V$_H$: EVQLVESGGGLVQPGGSLR LSCAASGFTVSYSSIHWVRQAP GKGLEWVASISSSSSSTYYADS VKGRFTISADTSKNTAYLQMNS LRAEDTAVYYCARGQQYYPD QYWGLDYWGQGTLVTVSS | 60 | 429 | 461 | 410 | 161 | 214 | 267 | 320 |

TABLE 2-continued

Antibodies directed against CRD2

| Clone | Sequence | VR | CDR 1 | CDR 2 | CDR 3 | LC/HC IgG1 SEQ ID NO: | IgG1 LALA | IgG4 | IgG4 mut |
|---|---|---|---|---|---|---|---|---|---|
| G9.2-21 | V<sub>L</sub>: DIQMTQSPSSLSASVGDRVTI TCRASQSVSSAVAWYQQKPGK APKLLIYSASSLYSGVPSRFSGS RSGTDFTLTISSLQPEDFATYYC QQSSSSSLFTFGQGTKVEIKR | 61 | 328 | 329 | 355 | 110 | 110 | 110 | 110 |
| G9.2-21 | V<sub>H</sub>: EVQLVESGGGLVQPGGSLR LSCAASGFTVSYSSIHWVRQAP GKGLEWVASIYSSSGYTYYAD SVKGRFTISADTSKNTAYLQMN SLRAEDTAVYYCARTYYTYFD WWRTAVYYGFDYWGQGTLV TVSS | 62 | 429 | 462 | 411 | 162 | 215 | 268 | 321 |
| G9.2-22 | V<sub>L</sub>: DIQMTQSPSSLSASVGDRVTI TCRASQSVSSAVAWYQQKPGK APKLLIYSASSLYSGVPSRFSGS RSGTDFTLTISSLQPEDFATYYC QQRWYPGDLITFGQGTKVEIK R | 63 | 328 | 329 | 356 | 111 | 111 | 111 | 111 |
| G9.2-22 | V<sub>H</sub>: EVQLVESGGGLVQPGGSLR LSCAASGFTVYSSSIHWVRQAP GKGLEWVASISSSYGYTSYADS VKGRFTISADTSKNTAYLQMNS LRAEDTAVYYCARDYYNYMSS YWWYSALDYWGQGTLVTVSS | 64 | 428 | 463 | 412 | 163 | 216 | 269 | 322 |
| G9.2-23 | V<sub>L</sub>: DIQMTQSPSSLSASVGDRVTI TCRASQSVSSAVAWYQQKPGK APKLLIYSASSLYSGVPSRFSGS RSGTDFTLTISSLQPEDFATYYC QQSYFPSLVTFGQGTKVEIKR | 65 | 328 | 329 | 357 | 112 | 112 | 112 | 112 |
| G9.2-23 | V<sub>H</sub>: EVQLVESGGGLVQPGGSLR LSCAASGFTVYSSSIHWVRQAP GKGLEWVASIYPYYGYTSYAD SVKGRFTISADTSKNTAYLQMN SLRAEDTAVYYCARKIFWPVS WMWQGYYPALDYWGQGTLV TVSS | 66 | 428 | 464 | 413 | 164 | 217 | 270 | 323 |
| G9.2-24 | V<sub>L</sub>: DIQMTQSPSSLSASVGDRVTI TCRASQSVSSAVAWYQQKPGK APKLLIYSASSLYSGVPSRFSGS RSGTDFTLTISSLQPEDFATYYC QQWSQSPVTFGQGTKVEIKR | 67 | 328 | 329 | 358 | 113 | 113 | 113 | 113 |
| G9.2-24 | V<sub>H</sub>: EVQLVESGGGLVQPGGSLR LSCAASGFTVYSSSIHWVRQAP GKGLEWVASIYSSYGYTSYAD SVKGRFTISADTSKNTAYLQMN SLRAEDTAVYYCARSYSSETHY GWAMDYWGQGTLVTVSS | 68 | 428 | 465 | 414 | 165 | 218 | 271 | 324 |
| G9.2-25 | V<sub>L</sub>: DIQMTQSPSSLSASVGDRVTI TCRASQSVSSAVAWYQQKPGK APKLLIYSASSLYSGVPSRFSGS RSGTDFTLTISSLQPEDFATYYC QQSYVYYPFTFGQGTKVEIKR | 69 | 328 | 329 | 359 | 114 | 114 | 114 | 114 |
| G9.2-25 | V<sub>H</sub>: EVQLVESGGGLVQPGGSLR LSCAASGFTLSSSSIHWVRQAP GKGLEWVASIYSSYGSTSYADS VKGRFTISADTSKNTAYLQMNS LRAEDTAVYYCARQYYTYFE WYMGWGYALDYWGQGTLVT VSS | 70 | 427 | 466 | 415 | 166 | 219 | 272 | 325 |
| G9.2-26 | V<sub>L</sub>: DIQMTQSPSSLSASVGDRVTI TCRASQSVSSAVAWYQQKPGK APKLLIYSASSLYSGVPSRFSGS RSGTDFTLTISSLQPEDFATYYC QQGGWYYGPITFGQGTKVEIK R | 71 | 328 | 329 | 360 | 115 | 115 | 115 | 115 |
| G9.2-26 | V<sub>H</sub>: EVQLVESGGGLVQPGGSLR LSCAASGFTVSSSSIHWVRQAP GKGLEWVAYISSYSGSTYYAD SVKGRFTISADTSKNTAYLQMN SLRAEDTAVYYCARSSALYWM DFSYSALDYWGQGTLVTVSS | 72 | 361 | 389 | 416 | 167 | 220 | 273 | 326 |

TABLE 2-continued

Antibodies directed against CRD2

| Clone | Sequence | VR | CDR 1 | CDR 2 | CDR 3 | LC/HC IgG1 | IgG1 LALA | IgG4 | IgG4 mut |
|---|---|---|---|---|---|---|---|---|---|
| | | | | | SEQ ID NO: | | | | |
| G9.2-low affinity binder | V$_L$: DIQMTQSPSSLSASVGDRVTI TCRASQSVSSAVAWYQQKPGK APKLLIYSASSLYSGVPSRFSGS RSGTDFTLTISSLQPEDFATYYC QQSSTDPITFGQGTKVEIKR | 54 | 328 | 329 | 352 | 108 | 108 | 108 | 108 |
| G9.2-low affinity binder | V$_H$: EVQLVESGGGLVQPGGSLR LSCAASGFTVSSSSIHWVRQAP GKGLEWVAYISSSSGYTYYAD SVKGRFTISADTSKNTAYLQMN SLRAEDTAVYYCARSSSSSSSS SSSSSDYWGQGTLVTVSS | 73 | 361 | 388 | 417 | 168 | 221 | 274 | 327 |

TABLE 3

Selected Antibody CDR Sequences

| Clone | | Sequence | SEQ ID NO: |
|---|---|---|---|
| G9.1-8 | V$_L$ CDR1 | RASQSVSSAVA | 328 |
| | V$_L$ CDR2 | SASSLYS | 329 |
| | V$_L$ CDR3 | QQSYYDSNPIT | 337 |
| | V$_H$ CDR1 | FTVSSSSIH | 361 |
| | V$_H$ CDR2 | YIYPYSGYTSYADSVKG | 364 |
| | V$_H$ CDR3 | YSTYSWGGIGKWVWGMDY | 374 |
| G9.1-8m1 | V$_L$ CDR1 | RASQSVSSAVA | 328 |
| | V$_L$ CDR2 | SASSLYS | 329 |
| | V$_L$ CDR3 | QQSYYDSNPIT | 337 |
| | V$_L$ CDR1 | FTVSSSSIH | 361 |
| | V$_H$ CDR2 | SSSSSSGYTSYADSVKG | 365 |
| | V$_H$ CDR3 | YSTYSWGGIGKWVWGMDY | 374 |
| G9.1-8m2 | V$_L$ CDR1 | RASQSVSSAVA | 328 |
| | V$_L$ CDR2 | SASSLYS | 329 |
| | V$_L$ CDR3 | QQSYYDSNPIT | 337 |
| | V$_L$ CDR1 | FTVSSSSIH | 361 |
| | V$_H$ CDR2 | YIYPYSSSSSYADSVKG | 366 |
| | V$_H$ CDR3 | YSTYSWGGIGKWVWGMDY | 374 |
| G9.1-8m3 | V$_L$ CDR1 | RASQSVSSAVA | 328 |
| | V$_L$ CDR2 | SASSLYS | 329 |
| | V$_L$ CDR3 | QQSYYDSNPIT | 337 |
| | V$_L$ CDR1 | FTVSSSSIH | 361 |
| | V$_H$ CDR2 | YIYPYSGYTSYADSVKG | 364 |
| | V$_H$ CDR3 | SSSSSWGGIGKWVWGMDY | 375 |
| G9.1-8m4 | V$_L$ CDR1 | RASQSVSSAVA | 328 |
| | V$_L$ CDR2 | SASSLYS | 329 |
| | V$_L$ CDR3 | QQSYYDSNPIT | 337 |
| | V$_L$ CDR1 | FTVSSSSIH | 361 |
| | V$_H$ CDR2 | YIYPYSGYTSYADSVKG | 364 |
| | V$_H$ CDR3 | YSTYSSSSSKWVWGMDY | 376 |
| G9.1-8m5 | V$_L$ CDR1 | RASQSVSSAVA | 328 |
| | V$_L$ CDR2 | SASSLYS | 329 |
| | V$_L$ CDR3 | QQSYYDSNPIT | 337 |
| | V$_H$ CDR1 | FTVSSSSIH | 361 |
| | V$_H$ CDR2 | YIYPYSGYTSYADSVKG | 364 |
| | V$_H$ CDR3 | YSTYSWGGIGSSSSSMDY | 377 |
| G9.1-8m6 | V$_L$ CDR1 | RASQSVSSAVA | 328 |
| | V$_L$ CDR2 | SASSLYS | 329 |
| | V$_L$ CDR3 | QQSYYDSNPIT | 337 |
| | V$_H$ CDR1 | FTVSSSSIH | 361 |
| | V$_H$ CDR2 | YIYPYSGYTSYADSVKG | 364 |
| | V$_H$ CDR3 | YSTYSSSSSKWVWGMDY | 378 |
| G9.1-8m7 | V$_L$ CDR1 | RASQSVSSAVA | 328 |
| | V$_L$ CDR2 | SASSLYS | 329 |
| | V$_L$ CDR3 | QQSYYDSNPIT | 337 |
| | V$_H$ CDR1 | FTVSSSSIH | 361 |
| | V$_H$ CDR2 | YIYPYSGYTSYADSVKG | 364 |
| | V$_H$ CDR3 | YSTYSSSSKWVWGMDY | 379 |
| G9.1-8m8 | V$_L$ CDR1 | RASQSVSSAVA | 328 |
| | V$_L$ CDR2 | SASSLYS | 329 |
| | V$_L$ CDR3 | QQSYYDSNPIT | 337 |
| | V$_H$ CDR1 | FTVSSSSIH | 361 |
| | V$_H$ CDR2 | YIYPYSGYTSYADSVKG | 364 |
| | V$_H$ CDR3 | YSTYSSSKWVWGMDY | 380 |
| G9.1-8m9 | V$_L$ CDR1 | RASQSVSSAVA | 328 |
| | V$_L$ CDR2 | SASSLYS | 329 |
| | V$_L$ CDR3 | QQSYYDSNPIT | 337 |
| | V$_H$ CDR1 | FTVSSSSIH | 361 |
| | V$_H$ CDR2 | YIYPYSGYTSYADSVKG | 364 |
| | V$_H$ CDR3 | YSTYSSKWVWGMDY | 383 |
| G9.1-8m10 | V$_L$ CDR1 | RASQSVSSAVA | 328 |
| | V$_L$ CDR2 | SASSLYS | 329 |
| | V$_L$ CDR3 | QQSYYDSNPIT | 337 |
| | V$_H$ CDR1 | FTVSSSSIH | 361 |
| | V$_H$ CDR2 | YIYPYSGYTSYADSVKG | 364 |
| | V$_H$ CDR3 | YSTYSKWVWGMDY | 381 |
| G9.1-8m11 | V$_L$ CDR1 | RASQSVSSAVA | 328 |
| | V$_L$ CDR2 | SASSLYS | 329 |
| | V$_L$ CDR3 | QQSYYDSNPIT | 337 |
| | V$_H$ CDR1 | FTVSSSSIH | 361 |
| | V$_H$ CDR2 | YIYPYSGYTSYADSVKG | 364 |
| | V$_H$ CDR3 | YSTYKWVWGMDY | 382 |
| G9.1-8m12 | V$_L$ CDR1 | RASQSVSSAVA | 328 |
| | V$_L$ CDR2 | SASSLYS | 329 |
| | V$_L$ CDR3 | QQSYYDSNPIT | 337 |
| | V$_H$ CDR1 | FTVSSSSIH | 361 |
| | V$_H$ CDR2 | YIYPYSSSSYADSVKG | 366 |
| | V$_H$ CDR3 | YSTYSSKWVWGMDY | 380 |
| G9.1-8m13 | V$_L$ CDR1 | RASQSVSSAVA | 328 |
| | V$_L$ CDR2 | SASSLYS | 329 |
| | V$_L$ CDR3 | QQSYYDSNPIT | 337 |
| | V$_H$ CDR1 | FTVSSSSIH | 361 |
| | V$_H$ CDR2 | YIYPYSSSSSYADSVKG | 366 |
| | V$_H$ CDR3 | YSTYSSKWVWGMDY | 383 |
| G9.1-8m14 | V$_L$ CDR1 | RASQSVSSAVA | 328 |
| | V$_L$ CDR2 | SASSLYS | 329 |
| | V$_L$ CDR3 | QQSYYDSNPIT | 337 |
| | V$_H$ CDR1 | FTVSSSSIH | 361 |
| | V$_H$ CDR2 | YIYPYSSSSSYADSVKG | 366 |
| | V$_H$ CDR3 | YSTYKWVWGMDY | 382 |
| G9.2-17 | V$_L$ CDR1 | RASQSVSSAVA | 328 |
| | V$_L$ CDR2 | SASSLYS | 329 |
| | V$_L$ CDR3 | QQSSTDPIT | 352 |
| | V$_H$ CDR1 | FTVSSSSIH | 361 |
| | V$_H$ CDR2 | YISSSSGYTYYADSVKG | 388 |
| | V$_H$ CDR3 | YWSYPSWWPYRGMDY | 406 |
| G9.2-17m6 | V$_L$ CDR1 | RASQSVSSAVA | 328 |
| | V$_L$ CDR2 | SASSLYS | 329 |
| | V$_L$ CDR3 | QQSSTDPIT | 352 |
| | V$_H$ CDR1 | FTVSSSSIH | 361 |
| | V$_H$ CDR2 | YISSSSGYTYYADSVKG | 388 |
| | V$_H$ CDR3 | YWSYPSWSPYRGMDY | 407 |

Such CRD1 and CRD2 binding anti-Galectin-9 antibodies are isolated and structurally characterized as described herein. The disclosure also contemplates antibodies having at least 80% identity (e.g., at least 85%, at least 90%, at least 95%, or at least 99% identity) to their variable region or CDR sequences. The VL amino acid sequences of G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, G9.2-26, G9.2-low affinity binder are set forth in SEQ ID NO: 29, 13, 34, 36, 38, 40, 42, 44, 46, 48, 29, 34, 54, 58, 61, 63, 65, 73, 67, 69, and 71. The VH amino acid sequences of G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, G9.2-26, G9.2-low affinity binder are set forth in SEQ ID NO: 30, 31, 32, 33, 35, 37, 39, 41, 43, 45, 47, 49, 50, 51, 52, 53, 55, 56, 57, 59, 60, 62, 64, 66, 68, 70, 72 and 73. Accordingly, provided herein are isolated anti-Galectin-9 antibodies, or antigen binding portion thereof, comprising heavy and light chain variable regions, wherein the light chain variable region comprises an amino acid sequence selected from SEQ ID NO: 29, 13, 34, 36, 38, 40, 42, 44, 46, 48, 29, 34, 54, 58, 61, 63, 65, 73, 67, 69, and 71. In some embodiments, the light chain variable regions consists of an amino acid sequence selected from SEQ ID NO: 29, 13, 34, 36, 38, 40, 42, 44, 46, 48, 29, 34, 54, 58, 61, 63, 65, 73, 67, 69, and 71. Also provided are isolated anti-Galectin-9 antibodies, or antigen binding portions thereof, comprising heavy and light chain variable regions, wherein the heavy chain variable region comprises an amino acid sequence selected from SEQ ID NO: 30, 31, 32, 33, 35, 37, 39, 41, 43, 45, 47, 49, 50, 51, 52, 53, 55, 56, 57, 59, 60, 62, 64, 66, 68, 70, 72 and 73. In some embodiments, the heavy chain variable regions consists of an amino acid sequence selected from SEQ ID NO: 30, 31, 32, 33, 35, 37, 39, 41, 43, 45, 47, 49, 50, 51, 52, 53, 55, 56, 57, 59, 60, 62, 64, 66, 68, 70, 72 and 73. Accordingly, provided herein are isolated anti-Galectin-9 antibodies, or antigen binding portion thereof, comprising heavy and light chain variable regions, wherein the light chain variable region comprises an amino acid sequence selected from SEQ ID NO: 29, 13, 34, 36, 38, 40, 42, 44, 46, 48, 29, 34, 54, 58, 61, 63, 65, 73, 67, 69, and 71, and the heavy chain variable region comprises an amino acid sequence selected from SEQ ID NO: 30, 31, 32, 33, 35, 37, 39, 41, 43, 45, 47, 49, 50, 51, 52, 53, 55, 56, 57, 59, 60, 62, 64, 66, 68, 70, 72 and 73. Accordingly, provided herein are isolated anti-Galectin-9 antibodies, or antigen binding portion thereof, comprising heavy and light chain variable regions, wherein the light chain variable region consists of an amino acid sequence selected from SEQ ID NO: 29, 13, 34, 36, 38, 40, 42, 44, 46, 48, 29, 34, 54, 58, 61, 63, 65, 73, 67, 69, and 71, and the heavy chain variable region consists of an amino acid sequence selected from SEQ ID NO: 30, 31, 32, 33, 35, 37, 39, 41, 43, 45, 47, 49, 50, 51, 52, 53, 55, 56, 57, 59, 60, 62, 64, 66, 68, 70, 72 and 73.

In some embodiments, the anti-Galectin-9 antibody comprises a VL region having the sequence of SEQ ID NO: 54. In some embodiments, the anti-Galectin-9 antibody comprises a VH region having the sequence of SEQ ID NO: 55. In some embodiments, the anti-Galectin-9 antibody comprises a VH region having the sequence of SEQ ID NO: 56. In some embodiments, the anti-Galectin-9 antibody comprises a VL region having the sequence of SEQ ID NO: 54 and a VH region having the sequence of SEQ ID NO: 55. In some embodiments, the anti-Galectin-9 antibody comprises a VL region having the sequence of SEQ ID NO: 54 and a VH region having the sequence of SEQ ID NO: 56.

The VL amino acid sequences of G9.1-1, G9.1-2, G9.1-3, G9.1-4, G9.1-5, G9.1-6, G9.1-7, G9.1-8, G9.1-9, G9.1-10, G9.1-11, G9.1-8m1, G9.1-8m2, G9.1-8m3, G9.1-8m4, G9.1-8m5, G9.1-8m6, G9.1-8m7, G9.1-8m8, G9.1-8m9, G9.1-8m10, G9.1-8m11, G9.1-8m12, G9.1-8m13, G9.1-8m14 are set forth in SEQ ID NO: 7, 9, 11, 13, 15, 17, 19, 21, 23, 25, and 27, respectively. The VH amino acid sequences of G9.1-1, G9.1-2, G9.1-3, G9.1-4, G9.1-5, G9.1-6, G9.1-7, G9.1-8, G9.1-9, G9.1-10, G9.1-11, G9.1-8m1, G9.1-8m2, G9.1-8m3, G9.1-8m4, G9.1-8m5, G9.1-8m6, G9.1-8m7, G9.1-8m8, G9.1-8m9, G9.1-8m10, G9.1-8m11, G9.1-8m12, G9.1-8m13, G9.1-8m14 are set forth in SEQ ID NO: 8, 10, 12, 14, 16, 18, 20, 22, 24, 26, 28, 74, 75, 76, 77, 78, 79, 80, 81, 82, 83, 84, 85, 86, and 87. Accordingly, provided herein are isolated anti-Galectin-9 antibodies, or antigen binding portions thereof, comprising heavy and light chain variable regions, wherein the light chain variable region comprises an amino acid sequence selected from SEQ ID NO: 7, 9, 11, 13, 15, 17, 19, 21, 23, 25, and 27. In some embodiments, the light chain variable region consists of an amino acid sequence selected from SEQ ID NO: 7, 9, 11, 13, 15, 17, 19, 21, 23, 25, and 27. Also provided are isolated anti-Galectin-9 antibodies, or antigen binding portions thereof, comprising heavy and light chain variable regions, wherein the heavy chain variable region comprises an amino acid sequence selected from SEQ ID NO: 8, 10, 12, 14, 16, 18, 20, 22, 24, 26, 28, 74, 75, 76, 77, 78, 79, 80, 81, 82, 83, 84, 85, 86, and 87. In some embodiments, the heavy chain variable regions consists of an amino acid sequence selected from SEQ ID NO: 8, 10, 12, 14, 16, 18, 20, 22, 24, 26, 28, 74, 75, 76, 77, 78, 79, 80, 81, 82, 83, 84, 85, 86, and 87. Accordingly, provided herein are isolated anti-Galectin-9 antibodies, or antigen binding portions thereof, comprising heavy and light chain variable regions, wherein the light chain variable region comprises an amino acid sequence selected from SEQ ID NO: 7, 9, 11, 13, 15, 17, 19, 21, 23, 25, and 27 and the heavy chain variable region comprises an amino acid sequence selected from SEQ ID NO: 8, 10, 12, 14, 16, 18, 20, 22, 24, 26, 28, 74, 75, 76, 77, 78, 79, 80, 81, 82, 83, 84, 85, 86, and 87. In some embodiments, the light chain variable regions consists of an amino acid sequence selected from SEQ ID NO: 7, 9, 11, 13, 15, 17, 19, 21, 23, 25, and 27, and the heavy chain variable regions consists of an amino acid sequence selected from SEQ ID NO: 8, 10, 12, 14, 16, 18, 20, 22, 24, 26, 28, 74, 75, 76, 77, 78, 79, 80, 81, 82, 83, 84, 85, 86, and 87.

In some embodiments, the anti-Galectin-9 antibody comprises a VL region having the sequence of SEQ ID NO: 21. In some embodiments, the anti-Galectin-9 antibody comprises a VH region having the sequence of SEQ ID NO: 22. In some embodiments, the anti-Galectin-9 antibody comprises a VH region having the sequence of SEQ ID NO: 86. In some embodiments, the anti-Galectin-9 antibody comprises a VL region having the sequence of SEQ ID NO: 21 and a VH region having the sequence of SEQ ID NO: 22. In some embodiments, the anti-Galectin-9 antibody comprises a VL region having the sequence of SEQ ID NO: 21 and a VH region having the sequence of SEQ ID NO: 86.

In some specific embodiments, the anti-Galectin-9 antibody or antigen binding portion thereof comprises any of SEQ ID NO: 7-87. In some specific embodiments, the anti-Galectin-9 antibody comprises one or more sequences of any sequence(s) selected from SEQ ID NO: 7-87 and any combination(s) thereof.

In some specific embodiments, the anti-Galectin-9 antibody or antigen binding portion thereof comprises any of SEQ ID NOs: 7-28 and 74-87. In some specific embodiments, the anti-Galectin-9 antibody or antigen binding portion thereof comprises one or more sequences of any sequence(s) selected from SEQ ID NO: 7-28 and 74-87 and any combination(s) thereof.

In some specific embodiments, the anti-Galectin-9 antibody or antigen binding portion thereof comprises any of SEQ ID NOs: 13, 29-73. In some specific embodiments, the anti-Galectin-9 antibody or antigen binding portion thereof comprises one or more sequences of any sequence(s) selected from SEQ ID NO: 13, 29-73 and any combination(s) thereof. In some specific embodiments, the anti-Galectin-9 antibody or antigen binding portion thereof comprises any of SEQ ID NOs: 54, 55, or 54 and 56. In some specific embodiments, the anti-Galectin-9 antibody or antigen binding portion thereof comprises one or more sequences of any sequence(s) selected from SEQ ID NO: 54, 55, or 54 and 56 and any combination(s) thereof.

In some embodiments, the anti-Galectin-9 antibody or antigen binding portion thereof comprises a VL region comprising SEQ ID NO: 54. In some embodiments, the anti-Galectin-9 antibody or antigen binding portion thereof comprises a VH region comprising SEQ ID NO: 55. In some embodiments, the anti-Galectin-9 antibody comprises a VL region consisting of SEQ ID NO: 54. In some embodiments, the anti-Galectin-9 antibody or antigen binding portion thereof comprises a VH region consisting of SEQ ID NO: 55. In some embodiments, the anti-Galectin-9 antibody comprises a VL and VH region comprising SEQ ID NO: 54 and 55. In some specific embodiments, the anti-Galectin-9 antibody or antigen binding portion thereof comprises a VL and VH region consisting of SEQ ID NO: 54 and 55.

In some embodiments, the anti-Galectin-9 antibody or antigen binding portion thereof comprises a VL region comprising SEQ ID NO: 21. In some embodiments, the anti-Galectin-9 antibody or antigen binding portion thereof comprises a VL region consisting of SEQ ID NO: 21. In some embodiments, the anti-Galectin-9 antibody or antigen binding portion thereof comprises a VH region comprising SEQ ID NO: 86. In some embodiments, the anti-Galectin-9 antibody or antigen binding portion thereof comprises a VH region consisting of SEQ ID NO: 86. In some embodiments, the anti-Galectin-9 antibody or antigen binding portion thereof comprises a VL and VH region comprising SEQ ID NO: 21 and 86. In some embodiments, the anti-Galectin-9 antibody or antigen binding portion thereof comprises a VL and VH region consisting of SEQ ID NO: 21 and 86.

In some specific embodiments, the anti-Galectin-9 antibody or antigen binding portion thereof comprises a VL or VH region comprising any of of SEQ ID NOs: 21, 22 and 74-87. In some specific embodiments, the anti-Galectin-9 antibody or antigen binding portion thereof comprises a VL or VH region consisting of SEQ ID NOs: 21, 22 and 74-87. In some specific embodiments, the anti-Galectin-9 antibody or antigen binding portion thereof comprises a VL and/or VH region comprising sequence(s) selected from SEQ ID NO: 21, 22 and 74-87 and any combination(s) thereof. In some specific embodiments, the anti-Galectin-9 antibody or antigen binding portion thereof comprises a VL and/or VH region consisting of sequence(s) selected from SEQ ID NO: 21, 22 and 74-87 and any combination(s) thereof.

In some embodiments, the anti-Galectin-9 antibody or antigen binding portion thereof comprises a VL region and a VH region comprising SEQ ID NO: 7 and SEQ ID NO: 8. In some embodiments, the anti-Galectin-9 antibody or antigen binding portion thereof comprises a VL region and a VH region comprising SEQ ID NO: 9 and SEQ ID NO: 10. In some embodiments, the anti-Galectin-9 antibody or antigen binding portion thereof comprises a VL region and a VH region comprising SEQ ID NO: 11 and SEQ ID NO: 12. In some embodiments, the anti-Galectin-9 antibody or antigen binding portion thereof comprises a VL region and a VH region comprising SEQ ID NO: 13 and SEQ ID NO: 14. In some embodiments, the anti-Galectin-9 antibody or antigen binding portion thereof comprises a VL region and a VH region comprising SEQ ID NO: 15 and SEQ ID NO: 16. In some embodiments, the anti-Galectin-9 antibody or antigen binding portion thereof comprises a VL region and a VH region comprising SEQ ID NO: 17 and SEQ ID NO: 18. In some embodiments, the anti-Galectin-9 antibody or antigen binding portion thereof comprises a VL region and a VH region comprising SEQ ID NO: 19 and SEQ ID NO: 20. In some embodiments, the anti-Galectin-9 antibody or antigen binding portion thereof comprises a VL region and a VH region comprising SEQ ID NO: 21 and SEQ ID NO: 22. In some embodiments, the anti-Galectin-9 antibody or antigen binding portion thereof comprises a VL region and a VH region comprising SEQ ID NO: 23 and SEQ ID NO: 24. In some embodiments, the anti-Galectin-9 antibody or antigen binding portion thereof comprises a VL region and a VH region comprising SEQ ID NO: 25 and SEQ ID NO: 26. In some embodiments, the anti-Galectin-9 antibody or antigen binding portion thereof comprises a VL region and a VH region comprising SEQ ID NO: 27 and SEQ ID NO: 28. In some embodiments, the anti-Galectin-9 antibody or antigen binding portion thereof comprises a VL region and a VH region comprising SEQ ID NO: 21 and SEQ ID NO: 74. In some embodiments, the anti-Galectin-9 antibody or antigen binding portion thereof comprises a VL region and a VH region comprising SEQ ID NO: 21 and SEQ ID NO: 75. In some embodiments, the anti-Galectin-9 antibody or antigen binding portion thereof comprises a VL region and a VH region comprising SEQ ID NO: 21 and SEQ ID NO: 76. In some embodiments, the anti-Galectin-9 antibody or antigen binding portion thereof comprises a VL region and a VH region comprising SEQ ID NO: 21 and SEQ ID NO: 77. In some embodiments, the anti-Galectin-9 antibody or antigen binding portion thereof comprises a VL region and a VH region comprising SEQ ID NO: 21 and SEQ ID NO: 78. In some embodiments, the anti-Galectin-9 antibody or antigen binding portion thereof comprises a VL region and a VH region comprising SEQ ID NO: 21 and SEQ ID NO: 79. In some embodiments, the anti-Galectin-9 antibody or antigen binding portion thereof comprises a VL region and a VH region comprising SEQ ID NO: 21 and SEQ ID NO: 80. In some embodiments, the anti-Galectin-9 antibody or antigen binding portion thereof comprises a VL region and a VH region comprising SEQ ID NO: 21 and SEQ ID NO: 81. In some embodiments, the anti-Galectin-9 antibody or antigen binding portion thereof comprises a VL region and a VH region comprising SEQ ID NO: 21 and SEQ ID NO: 82. In some embodiments, the anti-Galectin-9 antibody or antigen binding portion thereof comprises a VL region and a VH region comprising SEQ ID NO: 21 and SEQ ID NO: 83. In some embodiments, the anti-Galectin-9 antibody or antigen binding portion thereof comprises a VL region and a VH region comprising SEQ ID NO: 21 and SEQ ID NO: 84. In some embodiments, the anti-Galectin-9 antibody or antigen binding portion thereof comprises a VL region and a VH region comprising SEQ ID NO: 108 and SEQ ID NO: 85. In some embodiments, the anti-Galectin-9 antibody or antigen binding portion thereof comprises a VL region and a VH region comprising SEQ ID NO: 21 and SEQ ID NO: 86. In some embodiments, the anti-Galectin-9 antibody or antigen binding portion thereof comprises a VL region and a VH region comprising SEQ ID NO: 29 and SEQ ID NO: 30. In some embodiments, the anti-Galectin-9 antibody or antigen binding portion thereof comprises a VL region and a VH region comprising SEQ ID NO: 13 and SEQ ID NO: 31. In some embodiments, the anti-Galectin-9 antibody or antigen binding portion thereof comprises a VL region and a VH region comprising SEQ ID NO: 13 and SEQ ID NO: 32. In some embodiments, the anti-Galectin-9 antibody or antigen binding portion thereof comprises a VL region and a VH region comprising SEQ ID NO: 13 and SEQ ID NO: 33. In some embodiments, the anti-Galectin-9 antibody or antigen binding portion thereof comprises a VL region and a VH region comprising SEQ ID NO: 34 and SEQ ID NO: 35. In some embodiments, the anti-Galectin-9 antibody or antigen binding portion thereof comprises a VL region and a VH region comprising SEQ ID NO: 36 and SEQ ID NO: 37. In some embodiments, the anti-Galectin-9 antibody or antigen binding portion thereof comprises a VL region and a VH region comprising SEQ ID NO: 38 and SEQ ID NO: 39. In some embodiments, the anti-Galectin-9 antibody or antigen binding portion thereof comprises a VL region and a VH region comprising SEQ ID NO: 40 and SEQ ID NO: 41. In some embodiments, the anti-Galectin-9 antibody or antigen binding portion thereof comprises a VL region and a VH region comprising SEQ ID NO: 42 and SEQ ID NO: 43. In some embodiments, the anti-Galectin-9 antibody or antigen binding portion thereof comprises a VL region and a VH region comprising SEQ ID NO: 44 and SEQ ID NO: 45. In some embodiments, the anti-Galectin-9 antibody or antigen binding portion thereof comprises a VL region and a VH region comprising SEQ ID NO: 46 and SEQ ID NO: 47. In some embodiments, the anti-Galectin-9 antibody or antigen binding portion thereof comprises a VL region and a VH region comprising SEQ ID NO: 48 and SEQ ID NO: 49. In some embodiments, the anti-Galectin-9 antibody or antigen binding portion thereof comprises a VL region and a VH region comprising SEQ ID NO: 29 and SEQ ID NO: 50. In some embodiments, the anti-Galectin-9 antibody or antigen binding portion thereof comprises a VL region and a VH region comprising SEQ ID NO: 13 and SEQ ID NO: 51. In some embodiments, the anti-Galectin-9 antibody or antigen binding portion thereof comprises a VL region and a VH region comprising SEQ ID NO: 34 and SEQ ID NO: 52. In some embodiments, the anti-Galectin-9 antibody or antigen binding portion thereof comprises a VL region and a VH region comprising SEQ ID NO: 13 and SEQ ID NO: 53. In some embodiments, the anti-Galectin-9 antibody or antigen binding portion thereof comprises a VL region and a VH region comprising SEQ ID NO: 54 and SEQ ID NO: 55. In some embodiments, the anti-Galectin-9 antibody or antigen binding portion thereof comprises a VL region and a VH region comprising SEQ ID NO: 13 and SEQ ID NO: 57. In some embodiments, the anti-Galectin-9 antibody or antigen binding portion thereof comprises a VL region and a VH region comprising SEQ ID NO: 58 and SEQ ID NO: 59. In some embodiments, the anti-Galectin-9 antibody or antigen binding portion thereof comprises a VL region and a VH region comprising SEQ ID NO: 54 and SEQ ID NO: 60. In some embodiments, the anti-Galectin-9 antibody or antigen binding portion thereof comprises a VL region and a VH region comprising SEQ ID NO: 61 and SEQ ID NO: 62. In some embodiments, the anti-Galectin-9 antibody or antigen binding portion thereof comprises a VL region and a VH region comprising SEQ ID NO: 63 and SEQ ID NO: 64. In some embodiments, the anti-Galectin-9 antibody or antigen binding portion thereof comprises a VL region and a VH region comprising SEQ ID NO: 65 and SEQ ID NO: 66. In some embodiments, the anti-Galectin-9 antibody or antigen binding portion thereof comprises a VL region and a VH region comprising SEQ ID NO: 54 and SEQ ID NO: 56. In some embodiments, the anti-Galectin-9 antibody or antigen binding portion thereof comprises a VL region and a VH region comprising SEQ ID NO: 67 and SEQ ID NO: 68. In some embodiments, the anti-Galectin-9 antibody or antigen binding portion thereof comprises a VL region and a VH region comprising SEQ ID NO: 69 and SEQ ID NO: 70. In some embodiments, the anti-Galectin-9 antibody or antigen binding portion thereof comprises a VL region and a VH region comprising SEQ ID NO: 71 and SEQ ID NO: 72. In some embodiments, the anti-Galectin-9 antibody or antigen binding portion thereof comprises a VL region and a VH region comprising SEQ ID NO: 54 and SEQ ID NO: 73. In some specific embodiments, the anti-Galectin-9 antibody or antigen binding portion thereof comprises a VL region and a VH region consisting of SEQ ID NO: 7 and SEQ ID NO: 8. In some specific embodiments, the anti-Galectin-9 antibody or antigen binding portion thereof comprises a VL region and a VH region consisting of SEQ ID NO: 9 and SEQ ID NO: 10. In some specific embodiments, the anti-Galectin-9 antibody or antigen binding portion thereof comprises a VL region and a VH region consisting of SEQ ID NO: 11 and SEQ ID NO: 12. In some specific embodiments, the anti-Galectin-9 antibody or antigen binding portion thereof comprises a VL region and a VH region consisting of SEQ ID NO: 13 and SEQ ID NO: 14. In some specific embodiments, the anti-Galectin-9 antibody or antigen binding portion thereof comprises a VL region and a VH region consisting of SEQ ID NO: 15 and SEQ ID NO: 16. In some specific embodiments, the anti-Galectin-9 antibody or antigen binding portion thereof comprises a VL region and a VH region consisting of SEQ ID NO: 17 and SEQ ID NO: 18. In some specific embodiments, the anti-Galectin-9 antibody or antigen binding portion thereof comprises a VL region and a VH region consisting of SEQ ID NO: 19 and SEQ ID NO: 20. In some specific embodiments, the anti-Galectin-9 antibody or antigen binding portion thereof comprises a VL region and a VH region consisting of SEQ ID NO: 21 and SEQ ID NO: 22. In some specific embodiments, the anti-Galectin-9 antibody or antigen binding portion thereof comprises a VL region and a VH region consisting of SEQ ID NO: 23 and SEQ ID NO: 24. In some specific embodiments, the anti-Galectin-9 antibody or antigen binding portion thereof comprises a VL region and a VH region consisting of SEQ ID NO: 25 and SEQ ID NO: 26. In some specific embodiments, the anti-Galectin-9 antibody or antigen binding portion thereof comprises a VL region and a VH region consisting of SEQ ID NO: 27 and SEQ ID NO: 28. In some specific embodiments, the anti-Galectin-9 antibody or antigen binding portion thereof comprises a VL region and a VH region consisting of SEQ ID NO: 21 and SEQ ID NO: 74. In some specific embodiments, the anti-Galectin-9 antibody or antigen binding portion thereof comprises a VL region and a VH region consisting of SEQ ID NO: 21 and SEQ ID NO: 75. In some specific embodiments, the anti-Galectin-9 antibody or antigen binding portion thereof comprises a VL region and a VH region consisting of SEQ ID NO: 21 and SEQ ID NO: 76. In some specific embodiments, the anti-Galectin-9 antibody or antigen binding portion thereof comprises a VL region and a VH region consisting of SEQ ID NO: 21 and SEQ ID NO: 77. In some specific embodiments, the anti-Galectin-9 antibody or antigen binding portion thereof comprises a VL region and a VH region consisting of SEQ ID NO: 21 and SEQ ID NO: 78. In some specific embodiments, the anti-Galectin-9 antibody or antigen binding portion thereof comprises a VL region and a VH region consisting of SEQ ID NO: 21 and SEQ ID NO: 79. In some specific embodiments, the anti-Galectin-9 antibody or antigen binding portion thereof comprises a VL region and a VH region consisting of SEQ ID NO: 21 and SEQ ID NO: 80. In some specific embodiments, the anti-Galectin-9 antibody or antigen binding portion thereof comprises a VL region and a VH region consisting of SEQ ID NO: 21 and SEQ ID NO: 81. In some specific embodiments, the anti-Galectin-9 antibody or antigen binding portion thereof comprises a VL region and a VH region consisting of SEQ ID NO: 21 and SEQ ID NO: 82. In some specific embodiments, the anti-Galectin-9 antibody or antigen binding portion thereof comprises a VL region and a VH region consisting of SEQ ID NO: 21 and SEQ ID NO: 83. In some specific embodiments, the anti-Galectin-9 antibody or antigen binding portion thereof comprises a VL region and a VH region consisting of SEQ ID NO: 21 and SEQ ID NO: 84. In some specific embodiments, the anti-Galectin-9 antibody or antigen binding portion thereof comprises a VL region and a VH region consisting of SEQ ID NO: 108 and SEQ ID NO: 85. In some specific embodiments, the anti-Galectin-9 antibody or antigen binding portion thereof comprises a VL region and a VH region consisting of SEQ ID NO: 21 and SEQ ID NO: 86. In some specific embodiments, the anti-Galectin-9 antibody or antigen binding portion thereof comprises a VL region and a VH region consisting of SEQ ID NO: 29 and SEQ ID NO: 30. In some specific embodiments, the anti-Galectin-9 antibody or antigen binding portion thereof comprises a VL region and a VH region consisting of SEQ ID NO: 13 and SEQ ID NO: 31. In some specific embodiments, the anti-Galectin-9 antibody or antigen binding portion thereof comprises a VL region and a VH region consisting of SEQ ID NO: 13 and SEQ ID NO: 32. In some specific embodiments, the anti-Galectin-9 antibody or antigen binding portion thereof comprises a VL region and a VH region consisting of SEQ ID NO: 13 and SEQ ID NO: 33. In some specific embodiments, the anti-Galectin-9 antibody or antigen binding portion thereof comprises a VL region and a VH region consisting of SEQ ID NO: 34 and SEQ ID NO: 35. In some specific embodiments, the anti-Galectin-9 antibody or antigen binding portion thereof comprises a VL region and a VH region consisting of SEQ ID NO: 36 and SEQ ID NO: 37. In some specific embodiments, the anti-Galectin-9 antibody or antigen binding portion thereof comprises a VL region and a VH region consisting of SEQ ID NO: 38 and SEQ ID NO: 39. In some specific embodiments, the anti-Galectin-9 antibody or antigen binding portion thereof comprises a VL region and a VH region consisting of SEQ ID NO: 40 and SEQ ID NO: 41. In some specific embodiments, the anti-Galectin-9 antibody or antigen binding portion thereof comprises a VL region and a VH region consisting of SEQ ID NO: 42 and SEQ ID NO: 43. In some specific embodiments, the anti-Galectin-9 antibody or antigen binding portion thereof comprises a VL region and a VH region consisting of SEQ ID NO: 44 and SEQ ID NO: 45. In some specific embodiments, the anti-Galectin-9 antibody or antigen binding portion thereof comprises a VL region and a VH region consisting of SEQ ID NO: 46 and SEQ ID NO: 47. In some specific embodiments, the anti-Galectin-9 antibody or antigen binding portion thereof comprises a VL region and a VH region consisting of SEQ ID NO: 48 and SEQ ID NO: 49. In some specific embodiments, the anti-Galectin-9 antibody or antigen binding portion thereof comprises a VL region and a VH region consisting of SEQ ID NO: 29 and SEQ ID NO: 50. In some specific embodiments, the anti-Galectin-9 antibody or antigen binding portion thereof comprises a VL region and a VH region consisting of SEQ ID NO: 13 and SEQ ID NO: 51. In some specific embodiments, the anti-Galectin-9 antibody or antigen binding portion thereof comprises a VL region and a VH region consisting of SEQ ID NO: 34 and SEQ ID NO: 52. In some specific embodiments, the anti-Galectin-9 antibody or antigen binding portion thereof comprises a VL region and a VH region consisting of SEQ ID NO: 13 and SEQ ID NO: 53. In some specific embodiments, the anti-Galectin-9 antibody or antigen binding portion thereof comprises a VL region and a VH region consisting of SEQ ID NO: 54 and SEQ ID NO: 55. In some specific embodiments, the anti-Galectin-9 antibody or antigen binding portion thereof comprises a VL region and a VH region consisting of SEQ ID NO: 13 and SEQ ID NO: 57. In some specific embodiments, the anti-Galectin-9 antibody or antigen binding portion thereof comprises a VL region and a VH region consisting of SEQ ID NO: 58 and SEQ ID NO: 59. In some specific embodiments, the anti-Galectin-9 antibody or antigen binding portion thereof comprises a VL region and a VH region consisting of SEQ ID NO: 54 and SEQ ID NO: 60. In some specific embodiments, the anti-Galectin-9 antibody or antigen binding portion thereof comprises a VL region and a VH region consisting of SEQ ID NO: 61 and SEQ ID NO: 62. In some specific embodiments, the anti-Galectin-9 antibody or antigen binding portion thereof comprises a VL region and a VH region consisting of SEQ ID NO: 63 and SEQ ID NO: 64. In some specific embodiments, the anti-Galectin-9 antibody or antigen binding portion thereof comprises a VL region and a VH region consisting of SEQ ID NO: 65 and SEQ ID NO: 66. In some specific embodiments, the anti-Galectin-9 antibody or antigen binding portion thereof comprises a VL region and a VH region consisting of SEQ ID NO: 54 and SEQ ID NO: 56. In some specific embodiments, the anti-Galectin-9 antibody or antigen binding portion thereof comprises a VL region and a VH region consisting of SEQ ID NO: 67 and SEQ ID NO: 68. In some specific embodiments, the anti-Galectin-9 antibody or antigen binding portion thereof comprises a VL region and a VH region consisting of SEQ ID NO: 69 and SEQ ID NO: 70. In some specific embodiments, the anti-Galectin-9 antibody or antigen binding portion thereof comprises a VL region and a VH region consisting of SEQ ID NO: 71 and SEQ ID NO: 72. In some specific embodiments, the anti-Galectin-9 antibody or antigen binding portion thereof comprises a VL region and a VH region consisting of SEQ ID NO: 54 and SEQ ID NO: 73.

In some embodiments, the anti-Galectin-9 antibody comprises sequence having at least 80% (e.g., 80%, 85%, 90%, 95%, 96%, 97%, 98%, 99% and any incremental percent therein) sequence identity with any of the anti-Galectin-9 antibodies described in the previous paragraphs. In some embodiments, the anti-Galectin-9 antibody comprises a VL region that has at least 80% (e.g., 85%, 90%, 95%, 96%, 97%, 98%, 99% and any increment therein) sequence identity to a VL region set forth in SEQ ID NOs: 7, 9, 11, 13, 15, 17, 19, 21, 23, 25, and 27. In some embodiments, the anti-Galectin-9 antibody comprises a VH region that has at least 80% (e.g., 85%, 90%, 95%, 96%, 97%, 98%, 99% and any increment therein) sequence identity to a VH region set forth in SEQ ID NOs: 8, 10, 12, 14, 16, 18, 20, 22, 24, 26, 28, 74, 75, 76, 77, 78, 79, 80, 81, 82, 83, 84, 85, 86, and 87. In some embodiments, the anti-Galectin-9 antibody comprises a VL region that has at least 80% (e.g., 85%, 90%, 95%, 96%, 97%, 98%, 99% and any increment therein)

sequence identity to a VL region set forth in SEQ ID NOs: 7, 9, 11, 13, 15, 17, 19, 21, 23, 25, and 27 and a VH region that has at least 80% (e.g., 85%, 90%, 95%, 96%, 97%, 98%, 99% and any increment therein) sequence identity to a VH region set forth in SEQ ID NOs: 8, 10, 12, 14, 16, 18, 20, 22, 24, 26, 28, 74, 75, 76, 77, 78, 79, 80, 81, 82, 83, 84, 85, 86, and 87. In some embodiments, the anti-Galectin-9 antibody comprises a VL or VH region that has at least 80% (e.g., 85%, 90%, 95%, 96%, 97%, 98%, 99% and any increment therein) sequence identity to a VL or VH region set forth in SEQ ID NOs: 7-288 and 74-87. In some specific embodiments, the anti-Galectin-9 antibody comprises a VL or VH region that has at least 80% (e.g., 85%, 90%, 95%, 96%, 97%, 98%, 99% and any increment therein) sequence identity to a VL or VH region set forth in SEQ ID NO: 7-288 and 74-87 and any combination(s) thereof.

In some embodiments, the anti-Galectin-9 antibody comprises a VL region that has at least 80% (e.g., 85%, 90%, 95%, 96%, 97%, 98%, 99% and any increment therein) sequence identity to a VL region of an antibody selected from G9.1-1, G9.1-2, G9.1-3, G9.1-4, G9.1-5, G9.1-6, G9.1-7, G9.1-8, G9.1-9, G9.1-10, G9.1-11, G9.1-8m1, G9.1-8m2, G9.1-8m3, G9.1-8m4, G9.1-8m5, G9.1-8m6, G9.1-8m7, G9.1-8m8, G9.1-8m9, G9.1-8m10, G9.1-8m11, G9.1-8m12, G9.1-8m13, and G9.1-8m14. In some embodiments, the anti-Galectin-9 antibody comprises a VH region that has at least 80% (e.g., 85%, 90%, 95%, 96%, 97%, 98%, 99% and any increment therein) sequence identity to a VH region of an antibody selected from G9.1-1, G9.1-2, G9.1-3, G9.1-4, G9.1-5, G9.1-6, G9.1-7, G9.1-8, G9.1-9, G9.1-10, G9.1-11, G9.1-8m1, G9.1-8m2, G9.1-8m3, G9.1-8m4, G9.1-8m5, G9.1-8m6, G9.1-8m7, G9.1-8m8, G9.1-8m9, G9.1-8m10, G9.1-8m11, G9.1-8m12, G9.1-8m13, and G9.1-8m14. In some embodiments, the anti-Galectin-9 antibody comprises a VL and a VH region that has at least 80% (e.g., 85%, 90%, 95%, 96%, 97%, 98%, 99% and any increment therein) sequence identity to a VL or VH region of an antibody selected from G9.1-1, G9.1-2, G9.1-3, G9.1-4, G9.1-5, G9.1-6, G9.1-7, G9.1-8, G9.1-9, G9.1-10, G9.1-11, G9.1-8m1, G9.1-8m2, G9.1-8m3, G9.1-8m4, G9.1-8m5, G9.1-8m6, G9.1-8m7, G9.1-8m8, G9.1-8m9, G9.1-8m10, G9.1-8m11, G9.1-8m12, G9.1-8m13, and G9.1-8m14.

In some specific embodiments, the anti-Galectin-9 antibody comprises a VL or VH region that has at least 80% (e.g., 85%, 90%, 95%, 96%, 97%, 98%, 99% and any increment therein) sequence identity to a VL or VH region set forth in any of SEQ ID NOs: 21, 22 and 74-87. In some specific embodiments, the anti-Galectin-9 antibody comprises a VL or VH region that has at least 80% (e.g., 85%, 90%, 95%, 96%, 97%, 98%, 99% and any increment therein) sequence identity to a VL or VH region set forth in SEQ ID NO: 21, 22 and 74-87 and any combination(s) thereof.

In some specific embodiments, the anti-Galectin-9 antibody comprises a VL region that has at least 80% (e.g., 85%, 90%, 95%, 96%, 97%, 98%, 99% and any increment therein) sequence identity to the VL region of G9.1-8m13. In some embodiments, the anti-Galectin-9 antibody comprises a VH region that has at least 80% (e.g., 85%, 90%, 95%, 96%, 97%, 98%, 99% and any increment therein) sequence identity to the VH region of G9.1-8m13. In some embodiments, the anti-Galectin-9 antibody comprises a VL and a VH region that has at least 80% (e.g., 85%, 90%, 95%, 96%, 97%, 98%, 99% and any increment therein) sequence identity to the VL or VH region of G9.1-8m13.

In some embodiments, the anti-Galectin-9 antibody or antigen binding portion thereof comprises a VL region that has at least 80% (e.g., 85%, 90%, 95%, 96%, 97%, 98%, 99% and any increment therein) sequence identity to the VL region set forth in SEQ ID NO: 21. In some embodiments, the anti-Galectin-9 antibody or antigen binding portion thereof comprises a VH region that has at least 80% (e.g., 85%, 90%, 95%, 96%, 97%, 98%, 99% and any increment therein) sequence identity to the VH region set forth in SEQ ID NO: 86. In some embodiments, the anti-Galectin-9 antibody or antigen binding portion thereof comprises a VL and VH region that have at least 80% (e.g., 85%, 90%, 95%, 96%, 97%, 98%, 99% and any increment therein) sequence identity to the VL and VH regions set forth in SEQ ID NO: 21 and 86.

In some embodiments, the anti-Galectin-9 antibody comprises a VL region that has at least 80% (e.g., 85%, 90%, 95%, 96%, 97%, 98%, 99% and any increment therein) sequence identity to a VL region set forth in SEQ ID NO: 13, 29, 34, 36, 38, 40, 42, 44, 46, 48, 29, 34, 54, 58, 61, 63, 65, 73, 67, 69, and 71. In some embodiments, the anti-Galectin-9 antibody comprises a VH region that has at least 80% (e.g., 85%, 90%, 95%, 96%, 97%, 98%, 99% and any increment therein) sequence identity to a VH region set forth in SEQ ID NO: 30, 31, 32, 33, 35, 37, 39, 41, 43, 45, 47, 49, 50, 51, 52, 53, 55, 56, 57, 59, 60, 62, 64, 66, 68, 70, 72 and 73. In some embodiments, the anti-Galectin-9 antibody comprises a VL region that has at least 80% (e.g., 85%, 90%, 95%, 96%, 97%, 98%, 99% and any increment therein) sequence identity to a VL region set forth in SEQ ID NO: 13, 29, 34, 36, 38, 40, 42, 44, 46, 48, 29, 34, 54, 58, 61, 63, 65, 73, 67, 69, and 71 and a VH region that has at least 80% (e.g., 85%, 90%, 95%, 96%, 97%, 98%, 99% and any increment therein) sequence identity to a VH region set forth in SEQ ID NO: 30, 31, 32, 33, 35, 37, 39, 41, 43, 45, 47, 49, 50, 51, 52, 53, 55, 56, 57, 59, 60, 62, 64, 66, 68, 70, 72 and 73. In some specific embodiments, the anti-Galectin-9 antibody comprises a VL or VH region that has at least 80% (e.g., 85%, 90%, 95%, 96%, 97%, 98%, 99% and any increment therein) sequence identity to a VL or VH region set forth in SEQ ID NO: 29-75 and 77-85. In some specific embodiments, the anti-Galectin-9 antibody comprises a VL or VH region that has at least 80% (e.g., 85%, 90%, 95%, 96%, 97%, 98%, 99% and any increment therein) sequence identity to a VL or VH region set forth in SEQ ID NO: 13, 29-73 and any combination(s) thereof. In some specific embodiments, the anti-Galectin-9 antibody comprises a VL or VH region that has at least 80% (e.g., 85%, 90%, 95%, 96%, 97%, 98%, 99% and any increment therein) sequence identity to a VL or VH region set forth in any of SEQ ID NOs: 54, 55, and 56.

In some embodiments, the anti-Galectin-9 antibody comprises a VL region that has at least 80% (e.g., 85%, 90%, 95%, 96%, 97%, 98%, 99% and any increment therein) sequence identity to a VL region of an antibody selected from G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, G9.2-26, and G9.2-low affinity binder. In some embodiments, the anti-Galectin-9 antibody comprises a VH region that has at least 80% (e.g., 85%, 90%, 95%, 96%, 97%, 98%, 99% and any increment therein) sequence identity to a VH region of an antibody selected from G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, G9.2-26, and G9.2-low affinity binder. In some embodiments, the anti-Galectin-9 antibody comprises VL and VH regions that has at least 80% (e.g., 85%, 90%, 95%, 96%, 97%, 98%, 99% and any increment therein) sequence identity to VL and VH regions of an antibody selected from G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, G9.2-26, and G9.2-low affinity binder.

In some embodiments, the anti-Galectin-9 antibody comprises a heavy chain CDR having at least 80% (e.g., 80%, 85%, 90%, 95%, 96%, 97%, 98%, 99% and any incremental percent therein) sequence identity with a sequence selected from any of SEQ ID NO: 8, 10, 12, 14, 16, 18, 20, 22, 24, 26, 28, 30, 31, 32, 33, 35, 37, 39, 41, 43, 45, 47, 49, 50, 51, 52, 53, 55, 56, 57, 59, 60, 62, 64, 66, 68, 70, 72 73, 74, 75, 76, 77, 78, 79, 80, 81, 82, 83, 84, 85, 86, and 87. Alternatively or in addition, the anti-Galectin-9 antibody comprises a light chain CDR having at least 80% (e.g., 80%, 85%, 90%, 95%, 96%, 97%, 98%, 99% and any incremental percent therein) sequence identity with a sequence selected from any of SEQ ID NO: 7, 9, 11, 13, 15, 17, 19, 21, 23, 25, 27, 29, 34, 36, 38, 40, 42, 44, 46, 48, 54, 58, 61, 63, 65, 67, 69, 71, and 73.

In some specific embodiments, the anti-Galectin-9 antibody comprises a VL region that has at least 80% (e.g., 85%, 90%, 95%, 96%, 97%, 98%, 99% and any increment therein) sequence identity to the VL region of G9.2-17. In some specific embodiments, the anti-Galectin-9 antibody comprises a VH region that has at least 80% (e.g., 85%, 90%, 95%, 96%, 97%, 98%, 99% and any increment therein) sequence identity to the VH region of G9.2-17. In some specific embodiments, the anti-Galectin-9 antibody comprises VL and VH regions that has at least 80% (e.g., 85%, 90%, 95%, 96%, 97%, 98%, 99% and any increment therein) sequence identity to VL and VH regions of G9.2-17.

In some specific embodiments, the anti-Galectin-9 antibody or antigen binding fragment thereof comprises a VL that has at least 80% (e.g., 85%, 90%, 95%, 96%, 97%, 98%, 99% and any increment therein) sequence identity to a VL region set forth in SEQ ID NO: 54. In some specific embodiments, the anti-Galectin-9 antibody or antigen binding fragment thereof comprises a VH region that has at least 80% (e.g., 85%, 90%, 95%, 96%, 97%, 98%, 99% and any increment therein) sequence identity to a VH region set forth in SEQ ID NO: 55. In some specific embodiments, the anti-Galectin-9 antibody or antigen binding fragment thereof comprises a VL and/or VH region that has at least 80% (e.g., 85%, 90%, 95%, 96%, 97%, 98%, 99% and any increment therein) sequence identity to a VL and/or VH region set forth in SEQ ID NO: 54 and 55.

Complementarity Determining Regions (CDRs)

Anti-Galectin-9 antibodies, e.g., binding to CRD1, can comprise the light and heavy chain CDR1s, CDR2s and CDR3s of G9.1-1, G9.1-2, G9.1-3, G9.1-4, G9.1-5, G9.1-6, G9.1-7, G9.1-8, G9.1-9, G9.1-10, G9.1-11, G9.1-8m1, G9.1-8m2, G9.1-8m3, G9.1-8m4, G9.1-8m5, G9.1-8m6, G9.1-8m7, G9.1-8m8, G9.1-8m9, G9.1-8m10, G9.1-8m11, G9.1-8m12, G9.1-8m13, and G9.1-8m14, or combinations thereof. The amino acid sequence of the VL CDR1s of G9.1-1, G9.1-2, G9.1-3, G9.1-4, G9.1-5, G9.1-6, G9.1-7, G9.1-8, G9.1-9, G9.1-10, G9.1-11, G9.1-8m1, G9.1-8m2, G9.1-8m3, G9.1-8m4, G9.1-8m5, G9.1-8m6, G9.1-8m7, G9.1-8m8, G9.1-8m9, G9.1-8m10, G9.1-8m11, G9.1-8m12, G9.1-8m13, and G9.1-8m14 is set forth in SEQ ID NO: 328. The amino acid sequence of the VL CDR2s of G9.1-1, G9.1-2, G9.1-3, G9.1-4, G9.1-5, G9.1-6, G9.1-7, G9.1-8, G9.1-9, G9.1-10, G9.1-11, G9.1-8m1, G9.1-8m2, G9.1-8m3, G9.1-8m4, G9.1-8m5, G9.1-8m6, G9.1-8m7, G9.1-8m8, G9.1-8m9, G9.1-8m10, G9.1-8m11, G9.1-8m12, G9.1-8m13, and G9.1-8m14 is set forth in SEQ ID NO: 329. The amino acid sequences of the VL CDR3s of G9.1-1, G9.1-2, G9.1-3, G9.1-4, G9.1-5, G9.1-6, G9.1-7, G9.1-8, G9.1-9, G9.1-10, G9.1-11, G9.1-8m1, G9.1-8m2, G9.1-8m3, G9.1-8m4, G9.1-8m5, G9.1-8m6, G9.1-8m7, G9.1-8m8, G9.1-8m9, G9.1-8m10, G9.1-8m11, G9.1-8m12, G9.1-8m13, and G9.1-8m14 are set forth in SEQ ID NO: 330-340. The amino acid sequences of the VH CDR1s of G9.1-1, G9.1-2, G9.1-3, G9.1-4, G9.1-5, G9.1-6, G9.1-7, G9.1-8, G9.1-9, G9.1-10, G9.1-11, G9.1-8m1, G9.1-8m2, G9.1-8m3, G9.1-8m4, G9.1-8m5, G9.1-8m6, G9.1-8m7, G9.1-8m8, G9.1-8m9, G9.1-8m10, G9.1-8m11, G9.1-8m12, G9.1-8m13, and G9.1-8m14 are set forth in SEQ ID NO: 361, 427, 428, 431, 435, 436, 437. The amino acid sequences of the VH CDR2s of G9.1-1, G9.1-2, G9.1-3, G9.1-4, G9.1-5, G9.1-6, G9.1-7, G9.1-8, G9.1-9, G9.1-10, G9.1-11, G9.1-8m1, G9.1-8m2, G9.1-8m3, G9.1-8m4, G9.1-8m5, G9.1-8m6, G9.1-8m7, G9.1-8m8, G9.1-8m9, G9.1-8m10, G9.1-8m11, G9.1-8m12, G9.1-8m13, and G9.1-8m14 are set forth in SEQ ID NO: 362-366, and 438-445. The amino acid sequences of the VH CDR3s of G9.1-1, G9.1-2, G9.1-3, G9.1-4, G9.1-5, G9.1-6, G9.1-7, G9.1-8, G9.1-9, G9.1-10, G9.1-11, G9.1-8m1, G9.1-8m2, G9.1-8m3, G9.1-8m4, G9.1-8m5, G9.1-8m6, G9.1-8m7, G9.1-8m8, G9.1-8m9, G9.1-8m10, G9.1-8m11, G9.1-8m12, G9.1-8m13, and G9.1-8m14 are set forth in SEQ ID NO: 367-386.

In some embodiments, the anti-Galectin-9 antibody comprises a VL CDR1 having the sequence of SEQ ID NO: 328. In some embodiments, the anti-Galectin-9 antibody comprises a VL CDR2 having the sequence of SEQ ID NO: 329. In some embodiments, the anti-Galectin-9 antibody comprises a VL CDR3 having a sequence selected from any of SEQ ID NOs: 330-340. In some embodiments, the anti-Galectin-9 antibody comprises a VL CDR3 having the sequence of SEQ ID NO: 337. In some embodiments, the anti-Galectin-9 antibody comprises a VL CDR1 having the sequence of SEQ ID NO: 328, a VL CDR2 having the sequence of SEQ ID NO: 329, and a VL CDR3 having a sequence selected from any of SEQ ID NOs: 330-340. In some embodiments, the anti-Galectin-9 antibody comprises a VL CDR1 having the sequence of SEQ ID NO: 328, a VL CDR2 having the sequence of SEQ ID NO: 329, and a VL CDR3 having the sequence of SEQ ID NO: 337. In some embodiments, the anti-Galectin-9 antibody comprises a VH CDR1 having a sequence selected from any of SEQ ID NOs: 361, 427, 428, 431, 435, 436, and 437. In some embodiments, the anti-Galectin-9 antibody comprises a VH CDR1 having the sequence of SEQ ID NO: 361. In some embodiments, the anti-Galectin-9 antibody comprises a VH CDR2 having a sequence selected from any of SEQ ID NOs: 362-366, and 438-445. In some embodiments, the anti-Galectin-9 antibody comprises a VH CDR2 having a sequence selected from SEQ ID NO: 364 or 366. In some embodiments, the anti-Galectin-9 antibody comprises a VH CDR3 having a sequence selected from any of SEQ ID NOs: 367-386. In some embodiments, the anti-Galectin-9 antibody comprises a VH CDR3 having the sequence of SEQ ID NO: 374 or 383. In some embodiments, the anti-Galectin-9 antibody comprises a VH CDR1 having a sequence selected from any of SEQ ID NOs: 361, 427, 428, 431, 435, 436, and 437, a VH CDR2 having a sequence selected from any of SEQ ID NOs: 362-366 and 438-445, and a VH CDR3 having a sequence selected from any of SEQ ID NOs: 367-386. In some embodiments, the anti-Galectin-9 antibody comprises a VH CDR1 having the sequence of SEQ ID NO: 361, a VH CDR2 having the sequence of SEQ ID NO: 364, and a VH CDR3 having the sequence of SEQ ID NO: 374. In some embodiments, the anti-Galectin-9 antibody comprises a VH CDR1 having the sequence of SEQ ID NO: 361, a VH CDR2 having the sequence of SEQ ID NO: 366, and a VH CDR3 having the sequence of SEQ ID NO: 383. In some embodiments, the anti-Galectin-9 antibody comprises a VL CDR1 having the sequence of SEQ ID NO: 328, a VL CDR2 having the sequence of SEQ ID NO: 329, a VL CDR3 having a sequence selected from any of SEQ ID NOs: 330-340, a VH CDR1 having a sequence selected from any of SEQ ID NOs: 361, 427, 428, 431, 435, 436, and 437, a VH CDR2 having a sequence selected from any of SEQ ID NOs: 362-366 and 438-445, and a VH CDR3 having a sequence selected from any of SEQ ID NOs: 367-386. In some embodiments, the anti-Galectin-9 antibody comprises a VL CDR1 having the sequence of SEQ ID NO: 328, a VL CDR2 having the sequence of SEQ ID NO: 329, a VL CDR3 having the sequence of SEQ ID NO: 337, a VH CDR1 having the sequence of SEQ ID NO: 361, a VH CDR2 having the sequence of SEQ ID NO: 364, and a VH CDR3 having the sequence of SEQ ID NO: 374. In some embodiments, the anti-Galectin-9 antibody comprises a VL CDR1 having the sequence of SEQ ID NO: 328, a VL CDR2 having the sequence of SEQ ID NO: 329, a VL CDR3 having the sequence of SEQ ID NO: 337, a VH CDR1 having the sequence of SEQ ID NO: 361, a VH CDR2 having the sequence of SEQ ID NO: 366, and a VH CDR3 having the sequence of SEQ ID NO: 383. In any of these embodiments, the anti-Galectin-9 antibody binds to CRD1.

In some embodiments, the anti-Galectin-9 antibodies, e.g., binding to CRD2, comprise the light and heavy chain CDR1s, CDR2s and CDR3s of G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, G9.2-26, and G9.2-low affinity binder, or combinations thereof. The amino acid sequence of the VL CDR1s of G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, G9.2-26, and G9.2-low affinity binder is set forth in SEQ ID NO: 328. The amino acid sequence of the VL CDR2s of G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, G9.2-26, and G9.2-low affinity binder is set forth in SEQ ID NO: 329. The amino acid sequences of the VL CDR3s of G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, G9.2-26, and G9.2-low affinity binder are set forth in SEQ ID NO: 341-360. The amino acid sequences of the VH CDR1 of G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, G9.2-26, and G9.2-low affinity binder are set forth in SEQ ID NO: 361, 424-434. The amino acid sequences of the VH CDR2s of G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, G9.2-26, and G9.2-low affinity binder are set forth in SEQ ID NO: 362, 363, 387-389 and 446-466. The amino acid sequences of the VH CDR3s of G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, G9.2-26, and G9.2-low affinity binder are set forth in SEQ ID NO: 390-417.

In some embodiments, the anti-Galectin-9 antibody comprises a VL CDR1 having the sequence of SEQ ID NO: 328. In some embodiments, the anti-Galectin-9 antibody comprises a VL CDR2 having the sequence of SEQ ID NO: 329. In some embodiments, the anti-Galectin-9 antibody comprises a VL CDR3 having a sequence selected from any of SEQ ID NOs: 341-360. In some embodiments, the anti-Galectin-9 antibody comprises a VL CDR3 having the sequence of SEQ ID NO: 352. In some embodiments, the anti-Galectin-9 antibody comprises a VL CDR1 having the sequence of SEQ ID NO: 328, a VL CDR2 having the sequence of SEQ ID NO: 329, and a VL CDR3 having a sequence selected from any of SEQ ID NOs: 341-360. In some embodiments, the anti-Galectin-9 antibody comprises a VL CDR1 having the sequence of SEQ ID NO: 328, a VL CDR2 having the sequence of SEQ ID NO: 329, and a VL CDR3 having the sequence of SEQ ID NO: 352. In some embodiments, the anti-Galectin-9 antibody comprises a VH CDR1 having a sequence selected from any of SEQ ID NOs: 361, and 424-434. In some embodiments, the anti-Galectin-9 antibody comprises a VH CDR1 having the sequence of SEQ ID NO: 361. In some embodiments, the anti-Galectin-9 antibody comprises a VH CDR2 having a sequence selected from any of SEQ ID NOs: 362, 363, 387-389 and 446-466. In some embodiments, the anti-Galectin-9 antibody comprises a VH CDR2 having the sequence of SEQ ID NO: 388. In some embodiments, the anti-Galectin-9 antibody comprises a VH CDR3 having a sequence selected from any of SEQ ID NOs: 390-417. In some embodiments, the anti-Galectin-9 antibody comprises a VH CDR3 having the sequence of SEQ ID NO: 406 or 407. In some embodiments, the anti-Galectin-9 antibody comprises a VH CDR1 having a sequence selected from any of SEQ ID NOs: 361, and 424-434, a VH CDR2 having a sequence selected from any of SEQ ID NOs: 362, 363, 387-389 and 446-466, and a VH CDR3 having a sequence selected from any of SEQ ID NOs: 390-417. In some embodiments, the anti-Galectin-9 antibody comprises a VH CDR1 having the sequence of SEQ ID NO: 361, a VH CDR2 having the sequence of SEQ ID NO: 388, and a VH CDR3 having the sequence of SEQ ID NO: 406. In some embodiments, the anti-Galectin-9 antibody comprises a VH CDR1 having the sequence of SEQ ID NO: 361, a VH CDR2 having the sequence of SEQ ID NO: 388, and a VH CDR3 having the sequence of SEQ ID NO: 407. In some embodiments, the anti-Galectin-9 antibody comprises a VL CDR1 having the sequence of SEQ ID NO: 328, a VL CDR2 having the sequence of SEQ ID NO: 329, a VL CDR3 having a sequence selected from any of SEQ ID NOs: 341-360, a VH CDR1 having a sequence selected from any of SEQ ID NOs: 361, and 424-434, a VH CDR2 having a sequence selected from any of SEQ ID NOs: 362, 363, 387-389 and 446-466, and a VH CDR3 having a sequence selected from any of SEQ ID NOs: 390-417. In some embodiments, the anti-Galectin-9 antibody comprises a VL CDR1 having the sequence of SEQ ID NO: 328, a VL CDR2 having the sequence of SEQ ID NO: 329, a VL CDR3 having the sequence of SEQ ID NO: 352, a VH CDR1 having the sequence of SEQ ID NO: 361, a VH CDR2 having the sequence of SEQ ID NO: 388, and a VH CDR3 having the sequence of SEQ ID NO: 406. In some embodiments, the anti-Galectin-9 antibody comprises a VL CDR1 having the sequence of SEQ ID NO: 328, a VL CDR2 having the sequence of SEQ ID NO: 329, a VL CDR3 having the sequence of SEQ ID NO: 352, a VH CDR1 having the sequence of SEQ ID NO: 361, a VH CDR2 having the sequence of SEQ ID NO: 388, and a VH CDR3 having the sequence of SEQ ID NO: 407. In any of these embodiments, the anti-Galectin-9 antibody binds to CRD1.

Because Galectin-9 binding specificity is dictated essentially by the CDR1, 2 and 3 regions, the VH CDR1, 2 and 3 sequences and the VL CDR1, 2 and 3 sequences disclosed above, can be mixed and matched to generate new Galectin-9 binding antibodies, as long as each resulting new antibody has a VL CDR1, 2 and 3 and a VH CDR1, 2 and 3. Such antibodies resulting from a new combination of CDRs described herein can be tested using the binding assays described herein. In some embodiments, the CDR1, CDR2 and/or CDR3 sequence from a particular VH or VL sequence is replaced with a structurally similar CDR sequence(s). Novel VH and VL sequences can be created by substituting one or more VH and/or VL CDR sequence(s) with structurally similar sequences from the CDR sequences disclosed herein, according to methods known in the art.

Accordingly, in some embodiments, anti-Galectin-9 antibodies or antigen binding portions thereof comprise (a) VL CDR1 amino acid sequence set forth in SEQ ID NO: 328; (b) VL CDR2 amino acid sequence set forth in SEQ ID NO: 329; (c) VL CDR3 amino acid sequence selected from SEQ ID NO: 330-340 and 341-360 (d) VH CDR1 amino acid sequence set forth in SEQ ID NO: SEQ ID NO: 361, 427, 428, 431, 435, 436, 437; and SEQ ID NO: 361, 424-434 (e) VH CDR2 amino acid sequence selected from SEQ ID NO: 362-366 and 438-445, 362, 363, and 387-389 and 446-466; (f) VH CDR3 amino acid sequence selected from SEQ ID NO: 367-386 and 390-417.

In some embodiments, anti-Galectin-9 antibodies or antigen binding portions thereof comprise a VL CDR1 amino acid sequence set forth in SEQ ID NO: 328. In some embodiments, anti-Galectin-9 antibodies or antigen binding portions thereof comprise a VL CDR2 amino acid sequence set forth in SEQ ID NO: 329. In some embodiments, anti-Galectin-9 antibodies or antigen binding portions thereof comprise a VL CDR3 amino acid sequence selected from SEQ ID NO: 330-340. In some embodiments, anti-Galectin-9 antibodies or antigen binding portions thereof comprise a VH CDR1 amino acid sequence set forth in SEQ ID NO: 361, 427, 428, 431, 435, 436, 437. In some embodiments, anti-Galectin-9 antibodies or antigen binding portions thereof comprise a VH CDR2 amino acid sequence selected from SEQ ID NO: 362-366, and 438-445. In some embodiments, anti-Galectin-9 antibodies or antigen binding portions thereof comprise a VH CDR3 amino acid sequence selected from SEQ ID NO: 367-386. Accordingly, in some embodiments, anti-Galectin-9 antibodies or antigen binding portions thereof comprise (a) VL CDR1 amino acid sequence set forth in SEQ ID NO: 328; (b) VL CDR2 amino acid sequence set forth in SEQ ID NO: 329; (c) VL CDR3 amino acid sequence selected from SEQ ID NO: 330-340; (d) VH CDR1 amino acid sequence set forth in SEQ ID NO: 361, 427, 428, 431, 435, 436, 437; (e) VH CDR2 amino acid sequence selected from SEQ ID NO: 362-366 and 438-445; (f) VH CDR3 amino acid sequence selected from SEQ ID NO: 367-386.

In some embodiments, anti-Galectin-9 antibodies or antigen binding portions thereof comprise a VL CDR1 amino acid sequence set forth in SEQ ID NO: 328. In some embodiments, anti-Galectin-9 antibodies or antigen binding portions thereof comprise a VL CDR2 amino acid sequence set forth in SEQ ID NO: 329. In some embodiments, anti-Galectin-9 antibodies or antigen binding portions thereof comprise a VL CDR3 amino acid sequence selected from SEQ ID NO: 341-360. In some embodiments, anti-Galectin-9 antibodies or antigen binding portions thereof comprise a VH CDR1 amino acid sequence set forth in SEQ ID NO: 361, 424-434. In some embodiments, anti-Galectin-9 antibodies or antigen binding portions thereof comprise a VH CDR2 amino acid sequence selected from SEQ ID NO: 362, 363, 387-389 and 446-466. In some embodiments, anti-Galectin-9 antibodies or antigen binding portions thereof comprise a VH CDR3 amino acid sequence selected from SEQ ID NO: 390-417.

Accordingly, in some embodiments, anti-Galectin-9 antibodies or antigen binding portions thereof comprise (a) VL CDR1 amino acid sequence set forth in SEQ ID NO: 328; (b) VL CDR2 amino acid sequence set forth in SEQ ID NO: 329; (c) VL CDR3 amino acid sequence selected from SEQ ID NO: 341-360; (d) VH CDR1 amino acid sequence set forth in SEQ ID NO: 361; (e) VH CDR2s amino acid sequence selected from SEQ ID NO: 362, 363, 387-389 and 446-466; (f) VH CDR3 amino acid sequence selected from SEQ ID NO: 390-417.

9.1 Antibody Clones and Related CDRs

Clone 9.1-Derived Light Chain Variable Regions

In some embodiments, the anti-Galectin-9 antibody or antigen binding portion thereof comprises heavy and light chain variable regions, wherein the light chain variable region CDR1, CDR2, and CDR3 comprise SEQ ID NO: 328, 329, and 330, respectively. In some embodiments, the light chain variable region CDR1, CDR2, and CDR3 consist of SEQ ID NO: 328, 329, and 330, respectively. In some embodiments, the antibody comprises the same VL CDRs as G9.1-1.

In some embodiments, the anti-Galectin-9 antibody or antigen binding portion thereof comprises heavy and light chain variable regions, wherein the light chain variable region CDR1, CDR2, and CDR3 comprise SEQ ID NO: 328, 329, and 331, respectively. In some embodiments, the light chain variable region CDR1, CDR2, and CDR3 consist of SEQ ID NO: 328, 329, and 331, respectively. In some embodiments, the antibody comprises the same VL CDRs as G9.1-2.

In some embodiments, the anti-Galectin-9 antibody or antigen binding portion thereof comprises heavy and light chain variable regions, wherein the light chain variable region CDR1, CDR2, and CDR3 comprise SEQ ID NO: 328, 329, and 332, respectively. In some embodiments, the light chain variable region CDR1, CDR2, and CDR3 consist of SEQ ID NO: 328, 329, and 332, respectively. In some embodiments, the antibody comprises the same VL CDRs as G9.1-3.

In some embodiments, the anti-Galectin-9 antibody or antigen binding portion thereof comprises heavy and light chain variable regions, wherein the light chain variable region CDR1, CDR2, and CDR3 comprise SEQ ID NO: 328, 329, and 333, respectively. In some embodiments, the light chain variable region CDR1, CDR2, and CDR3 consist of SEQ ID NO: 328, 329, and 333, respectively. In some embodiments, the antibody comprises the same VL CDRs as G9.1-4.

n some embodiments, the anti-Galectin-9 antibody or antigen binding portion thereof comprises heavy and light chain variable regions, wherein the light chain variable region CDR1, CDR2, and CDR3 comprise SEQ ID NO: 328, 329, and 334, respectively. In some embodiments, the light chain variable region CDR1, CDR2, and CDR3 consist of SEQ ID NO: 328, 329, and 334, respectively. In some embodiments, the antibody comprises the same VL CDRs as G9.1-5.

In some embodiments, the anti-Galectin-9 antibody or antigen binding portion thereof comprises heavy and light chain variable regions, wherein the light chain variable region CDR1, CDR2, and CDR3 comprise SEQ ID NO: 328, 329, and 335, respectively. In some embodiments, the light chain variable region CDR1, CDR2, and CDR3 consist of SEQ ID NO: 328, 329, and 335, respectively. In some embodiments, the antibody comprises the same VL CDRs as G9.1-6.

n some embodiments, the anti-Galectin-9 antibody or antigen binding portion thereof comprises heavy and light chain variable regions, wherein the light chain variable region CDR1, CDR2, and CDR3 comprise SEQ ID NO: 328, 329, and 336, respectively. In some embodiments, the light chain variable region CDR1, CDR2, and CDR3 consist of SEQ ID NO: 328, 329, and 336, respectively. In some embodiments, the antibody comprises the same VL CDRs as G9.1-7.

In some embodiments, the anti-Galectin-9 antibody or antigen binding portion thereof comprises heavy and light chain variable regions, wherein the light chain variable region CDR1, CDR2, and CDR3 comprise SEQ ID NO: 328, 329, and 337, respectively. In some embodiments, the light chain variable region CDR1, CDR2, and CDR3 consist of SEQ ID NO: 328, 329, and 337, respectively. In some embodiments, the antibody comprises the same VL CDRs as G9.1-8.

In some embodiments, the anti-Galectin-9 antibody or antigen binding portion thereof comprises heavy and light chain variable regions, wherein the light chain variable region CDR1, CDR2, and CDR3 comprise SEQ ID NO: 328, 329, and 338, respectively. In some embodiments, the light chain variable region CDR1, CDR2, and CDR3 consist of SEQ ID NO: 328, 329, and 338, respectively. In some embodiments, the antibody comprises the same VL CDRs as G9.1-9.

In some embodiments, the anti-Galectin-9 antibody or antigen binding portion thereof comprises heavy and light chain variable regions, wherein the light chain variable region CDR1, CDR2, and CDR3 comprise SEQ ID NO: 328, 329, and 339, respectively. In some embodiments, the light chain variable region CDR1, CDR2, and CDR3 consist of SEQ ID NO: 328, 329, and 339, respectively. In some embodiments, the antibody comprises the same VL CDRs as G9.1-10.

In some embodiments, the anti-Galectin-9 antibody or antigen binding portion thereof comprises heavy and light chain variable regions, wherein the light chain variable region CDR1, CDR2, and CDR3 comprise SEQ ID NO: 328, 329, and 340, respectively. In some embodiments, the light chain variable region CDR1, CDR2, and CDR3 consist of SEQ ID NO: 328, 329, and 340, respectively. In some embodiments, the antibody comprises the same VL CDRs as G9.1-11.

In some embodiments, the anti-Galectin-9 antibody or antigen binding portion thereof comprises heavy and light chain variable regions, wherein the light chain variable region CDR1 comprises SEQ ID NO: 328. In some embodiments, the anti-Galectin-9 antibody or antigen binding portion thereof comprises heavy and light chain variable regions, wherein the light chain variable region CDR2 comprises SEQ ID NO: 329. In some embodiments, the anti-Galectin-9 antibody or antigen binding portion thereof comprises heavy and light chain variable regions, wherein the light chain variable region CDR3 comprises SEQ ID NO: 337. In some embodiments, the anti-Galectin-9 antibody or antigen binding portion thereof comprises heavy and light chain variable regions, wherein the light chain variable region CDR1 consists of SEQ ID NO: 328. In some embodiments, the anti-Galectin-9 antibody or antigen binding portion thereof comprises heavy and light chain variable regions, wherein the light chain variable region CDR2 consists of SEQ ID NO: 329. In some embodiments, the anti-Galectin-9 antibody or antigen binding portion thereof comprises heavy and light chain variable regions, wherein the light chain variable region CDR3 consists of SEQ ID NO: 337. In some embodiments, the antibody comprises the same VL CDRs as 9.1-8, G9.1-8m1, G9.1-8m2, G9.1-8m3, G9.1-8m4, G9.1-8m5, G9.1-8m6, G9.1-8m7, G9.1-8m8, G9.1-8m9, G9.1-8m10, G9.1-8m11, G9.1-8m12, G9.1-8m13, or G9.1-8m14. In some embodiments, the antibody comprises the same VL CDRs as G9.1-8m12. In some embodiments, the antibody comprises the same VL CDRs as G9.1-8m13.

In some embodiments, the anti-Galectin-9 antibody or binding portion thereof comprises heavy and light chain variable regions, wherein the heavy chain variable region CDR1 comprises SEQ ID NO: 328. In some embodiments, the anti-Galectin-9 antibody or binding portion thereof comprises heavy and light chain variable regions, wherein the light chain variable region CDR2 comprises $X_1X_2X_3X_4X_5SX_6X_7X_8$SYADSVKG (SEQ ID NO: 467), in which $X_1$=Y or S, $X_2$=I or S, $X_3$=Y or S, $X_4$=P or S, $X_5$=Y or S, $X_6$=G or S, $X_7$=Y or S, and $X_8$=T or S. In some embodiments, the anti-Galectin-9 antibody or binding portion thereof comprises heavy and light chain variable regions, wherein the light chain variable region CDR3 comprises $X_1SX_2X_3X_4X_5X_6X_7X_8X_9X_{10}KX_{11}X_{12}X_{13}$GMDY (SEQ ID NO: 468), in which $X_1$=Y or S, $X_2$=T, S, or absent, $X_3$=Y, S, or absent, $X_4$=S or absent, $X_5$=W, S, or absent, $X_6$=S or absent, $X_7$=G, S, or absent, $X_8$=G, T, S, or absent, $X_9$=I, Y, S, or absent, $X_{10}$=G, S, or Y, $X_{11}$=W or S, $X_{12}$=Y or S, and $X_{13}$=W or S. In some examples, the anti-Galectin-9 antibody contains G at $X_7$, Y at $X_8$, and/or T at $X_9$ in the heavy chain CDR2 domain. Alternatively, or in addition, the anti-Galectin-9 antibody contains deletions at one or more of $X_4$-$X_7$ in the heavy chain CDR3 domain. In other examples, the anti-Galectin-9 antibody contains S at one or more of $X_6$-$X_8$ in the heavy chain CDR2 domain. Alternatively or in addition, the anti-Galectin-9 antibody contains deletions at one or more of $X_5$-$X_7$ in the heavy chain CDR3 domain. In a further example, the anti-Galectin-9 antibody contains S at one or more of $X_6$-$X_8$ in the heavy chain CDR2 domain. Alternatively or in addition, the anti-Galectin-9 antibody contains deletions at one or more of $X_3$-$X_9$ and/or $X_{10}$ is Y in the heavy chain CDR3 domain.

Clone 9.1-Derived Heavy Chain Variable Regions

In some embodiments, the anti-Galectin-9 antibody or antigen binding portion thereof comprises heavy and light chain variable regions, wherein the heavy chain variable region CDR1, CDR2, and CDR3 comprise SEQ ID NO: 431, 438, and 367, respectively. In some embodiments, the heavy chain variable region CDR1, CDR2, and CDR3 consist of SEQ ID NO: 431, 438, and 367, respectively. In some embodiments, the antibody comprises the same VH CDRs as G9.1-1.

In some embodiments, the anti-Galectin-9 antibody or antigen binding portion thereof comprises heavy and light chain variable regions, wherein the heavy chain variable region CDR1, CDR2, and CDR3 comprise SEQ ID NO: 435, 439, and 368, respectively. In some embodiments, the heavy chain variable region CDR1, CDR2, and CDR3 consist of SEQ ID NO: 435, 439, and 368, respectively. In some embodiments, the antibody comprises the same VH CDRs as G9.1-2.

In some embodiments, the anti-Galectin-9 antibody or antigen binding portion thereof comprises heavy and light chain variable regions, wherein the heavy chain variable region CDR1, CDR2, and CDR3 comprise SEQ ID NO: 436, 363, and 369, respectively. In some embodiments, the heavy chain variable region CDR1, CDR2, and CDR3 consist of SEQ ID NO: 436, 363, and 369, respectively. In some embodiments, the antibody comprises the same VH CDRs as G9.1-3.

In some embodiments, the anti-Galectin-9 antibody or antigen binding portion thereof comprises heavy and light chain variable regions, wherein the heavy chain variable region CDR1, CDR2, and CDR3 comprise SEQ ID NO: 437, 440, and 370, respectively. In some embodiments, the heavy chain variable region CDR1, CDR2, and CDR3 consist of SEQ ID NO: 437, 440, and 370, respectively. In some embodiments, the antibody comprises the same VH CDRs as G9.1-4.

In some embodiments, the anti-Galectin-9 antibody or antigen binding portion thereof comprises heavy and light chain variable regions, wherein the heavy chain variable region CDR1, CDR2, and CDR3 comprise SEQ ID NO: 437, 441, and 371, respectively. In some embodiments, the heavy chain variable region CDR1, CDR2, and CDR3 consist of SEQ ID NO: 437, 441, and 371, respectively. In some embodiments, the antibody comprises the same VH CDRs as G9.1-5.

In some embodiments, the anti-Galectin-9 antibody or antigen binding portion thereof comprises heavy and light chain variable regions, wherein the heavy chain variable region CDR1, CDR2, and CDR3 comprise SEQ ID NO: 427, 442, and 372, respectively. In some embodiments, the heavy chain variable region CDR1, CDR2, and CDR3 consist of SEQ ID NO: 427, 442, and 372, respectively. In some embodiments, the antibody comprises the same VH CDRs as G9.1-6.

In some embodiments, the anti-Galectin-9 antibody or antigen binding portion thereof comprises heavy and light chain variable regions, wherein the heavy chain variable region CDR1, CDR2, and CDR3 comprise SEQ ID NO: 361, 443, and 373, respectively. In some embodiments, the heavy chain variable region CDR1, CDR2, and CDR3 consist of SEQ ID NO: 361, 443, and 373, respectively. In some embodiments, the antibody comprises the same VH CDRs as G9.1-7.

In some embodiments, the anti-Galectin-9 antibody or antigen binding portion thereof comprises heavy and light chain variable regions, wherein the heavy chain variable region CDR1, CDR2, and CDR3 comprise SEQ ID NO: 361, 364, and 374, respectively. In some embodiments, the heavy chain variable region CDR1, CDR2, and CDR3 consist of SEQ ID NO: 361, 364, and 374, respectively. In some embodiments, the antibody comprises the same VH CDRs as G9.1-8.

In some embodiments, the anti-Galectin-9 antibody or antigen binding portion thereof comprises heavy and light chain variable regions, wherein the heavy chain variable region CDR1, CDR2, and CDR3 comprise SEQ ID NO: 361, 363, and 384, respectively. In some embodiments, the heavy chain variable region CDR1, CDR2, and CDR3 consist of SEQ ID NO: 361, 363, and 384, respectively. In some embodiments, the antibody comprises the same VH CDRs as G9.1-9.

In some embodiments, the anti-Galectin-9 antibody or binding portion thereof comprises heavy and light chain variable regions, wherein the heavy chain variable region CDR1, CDR2, and CDR3 comprise SEQ ID NO: 429, 444, and 385, respectively. In some embodiments, the heavy chain variable region CDR1, CDR2, and CDR3 consist of SEQ ID NO: 429, 444, and 385, respectively. In some embodiments, the antibody comprises the same VH CDRs as G9.1-10. In some embodiments, the anti-Galectin-9 antibody or antigen binding portion thereof comprises heavy and light chain variable regions, wherein the heavy chain variable region CDR1, CDR2, and CDR3 comprise SEQ ID NO: 428, 445, and 386, respectively. In some embodiments, the heavy chain variable region CDR1, CDR2, and CDR3 consist of SEQ ID NO: 361, 445, and 386, respectively. In some embodiments, the antibody comprises the same VH CDRs as G9.1-11.

In some embodiments, the anti-Galectin-9 antibody or antigen binding portion thereof comprises heavy and light chain variable regions, wherein the heavy chain variable region CDR1, CDR2, and CDR3 comprise SEQ ID NO: 361, 365, and 374, respectively. In some embodiments, the heavy chain variable region CDR1, CDR2, and CDR3 consist of SEQ ID NO: 361, 365, and 374, respectively. In some embodiments, the antibody comprises the same VH CDRs as G9.1-8m1.

In some embodiments, the anti-Galectin-9 antibody or antigen binding portion thereof comprises heavy and light chain variable regions, wherein the heavy chain variable region CDR1, CDR2, and CDR3 comprise SEQ ID NO: 361, 366, and 374, respectively. In some embodiments, the heavy chain variable region CDR1, CDR2, and CDR3 consist of SEQ ID NO: 361, 366, and 374, respectively. In some embodiments, the antibody comprises the same VH CDRs as G9.1-8m2.

In some embodiments, the anti-Galectin-9 antibody or antigen binding portion thereof comprises heavy and light chain variable regions, wherein the heavy chain variable region CDR1, CDR2, and CDR3 comprise SEQ ID NO: 361, 364, and 375, respectively. In some embodiments, the heavy chain variable region CDR1, CDR2, and CDR3 consist of SEQ ID NO: 361, 364, and 375, respectively. In some embodiments, the antibody comprises the same VH CDRs as G9.1-8m3.

In some embodiments, the anti-Galectin-9 antibody or antigen binding portion thereof comprises heavy and light chain variable regions, wherein the heavy chain variable region CDR1, CDR2, and CDR3 comprise SEQ ID NO: 361, 364, and 376, respectively. In some embodiments, the heavy chain variable region CDR1, CDR2, and CDR3 regions consist of SEQ ID NO: 361, 364, and 376, respectively. In some embodiments, the antibody comprises the same VH CDRs as G9.1-8m4.

In some embodiments, the anti-Galectin-9 antibody or antigen binding portion thereof comprises heavy and light chain variable regions, wherein the heavy chain variable region CDR1, CDR2, and CDR3 comprise SEQ ID NO: 361, 364, and 377, respectively. In some embodiments, the heavy chain variable region CDR1, CDR2, and CDR3 consist of SEQ ID NO: 361, 364, and 377, respectively. In some embodiments, the antibody comprises the same VH CDRs as G9.1-8m5.

In some embodiments, the anti-Galectin-9 antibody or antigen binding portion thereof comprises heavy and light chain variable regions, wherein the heavy chain variable region CDR1, CDR2, and CDR3 comprise SEQ ID NO: 361, 364, and 378, respectively. In some embodiments, the heavy chain variable region CDR1, CDR2, and CDR3 consist of SEQ ID NO: 361, 364, and 378, respectively. In some embodiments, the antibody comprises the same VH CDRs as G9.1-8m6.

In some embodiments, the anti-Galectin-9 antibody or antigen binding portion thereof comprises heavy and light chain variable regions, wherein the heavy chain variable region CDR1, CDR2, and CDR3 comprise SEQ ID NO: 361, 364, and 379, respectively. In some embodiments, the heavy chain variable region CDR1, CDR2, and CDR3 consist of SEQ ID NO: 361, 364, and 379, respectively. In some embodiments, the antibody comprises the same VH CDRs as G9.1-8m7.

In some embodiments, the anti-Galectin-9 antibody or antigen binding portion thereof comprises heavy and light chain variable regions, wherein the heavy chain variable region CDR1, CDR2, and CDR3 comprise SEQ ID NO: 361, 364, and 380, respectively. In some embodiments, the heavy chain variable region CDR1, CDR2, and CDR3 consist of SEQ ID NO: 361, 364, and 380, respectively. In some embodiments, the antibody comprises the same VH CDRs as G9.1-8m8.

In some embodiments, the anti-Galectin-9 antibody or antigen binding portion thereof comprises heavy and light chain variable regions, wherein the heavy chain variable region CDR1, CDR2, and CDR3 comprise SEQ ID NO: 361, 364, and 383, respectively. In some embodiments, the heavy chain variable region CDR1, CDR2, and CDR3 consist of SEQ ID NO: 361, 364, and 383, respectively. In some embodiments, the antibody comprises the same VH CDRs as G9.1-8m9.

In some embodiments, the anti-Galectin-9 antibody or antigen binding portion thereof comprises heavy and light chain variable regions, wherein the heavy chain variable region CDR1, CDR2, and CDR3 comprise SEQ ID NO: 361, 364, and 381, respectively. In some embodiments, the heavy chain variable region CDR1, CDR2, and CDR3 consist of SEQ ID NO: 361, 364, and 381, respectively. In some embodiments, the antibody comprises the same VH CDRs as G9.1-8m10.

In some embodiments, the anti-Galectin-9 antibody or antigen binding portion thereof comprises heavy and light chain variable regions, wherein the heavy chain variable region CDR1, CDR2, and CDR3 comprise SEQ ID NO: 361, 364, and 382, respectively. In some embodiments, the heavy chain variable region CDR1, CDR2, and CDR3 consist of SEQ ID NO: 361, 364, and 382, respectively. In some embodiments, the antibody comprises the same VH CDRs as G9.1-8m11.

In some embodiments, the anti-Galectin-9 antibody or antigen binding portion thereof comprises heavy and light chain variable regions, wherein the heavy chain variable region CDR1, CDR2, and CDR3 comprise SEQ ID NO: 361, 366, and 380, respectively. In some embodiments, the heavy chain variable region CDR1, CDR2, and CDR3 consist of SEQ ID NO: 361, 366, and 380, respectively. In some embodiments, the antibody comprises the same VH CDRs as G9.1-8m12.

In some embodiments, the anti-Galectin-9 antibody or antigen binding portion thereof comprises heavy and light chain variable regions, wherein the heavy chain variable region CDR1 comprises SEQ ID NO: 361. In some embodiments, the anti-Galectin-9 antibody or antigen binding portion thereof comprises heavy and light chain variable regions, wherein the heavy chain variable region CDR2 comprises SEQ ID NO: 366. In some embodiments, the anti-Galectin-9 antibody or antigen binding portion thereof comprises heavy and light chain variable regions, wherein the heavy chain variable region CDR3 region comprises SEQ ID NO: 383. In some embodiments, the anti-Galectin-9 antibody or antigen binding portion thereof comprises heavy and light chain variable regions, wherein the heavy chain variable region CDR1 consists of SEQ ID NO: 361. In some embodiments, the anti-Galectin-9 antibody or antigen binding portion thereof comprises heavy and light chain variable regions, wherein the heavy chain variable region CDR2 consists of SEQ ID NO: 366. In some embodiments, the anti-Galectin-9 antibody or antigen binding portion thereof comprises heavy and light chain variable regions, wherein the heavy chain variable region CDR3 region consists of SEQ ID NO: 383. In some embodiments, the anti-Galectin-9 antibody or antigen binding portion thereof comprises heavy and light chain variable regions, wherein the heavy chain variable region CDR1, CDR2, and CDR3 comprise SEQ ID NO: 361, 366, and 383, respectively. In some embodiments, the heavy chain variable region CDR1, CDR2, and CDR3 consist of SEQ ID NO: 361, 366, and 383, respectively. In some embodiments, the antibody comprises the same VH CDRs as G9.1-8m13.

In some embodiments, the anti-Galectin-9 antibody or antigen binding portion thereof comprises heavy and light chain variable regions, wherein the heavy chain variable region CDR1, CDR2, and CDR3 comprise SEQ ID NO: 361, 366, and 382, respectively. In some embodiments, the heavy chain variable region CDR1, CDR2, and CDR3 consist of SEQ ID NO: 361, 366, and 382, respectively. In some embodiments, the antibody comprises the same VH CDRs as G9.1-8m14.

Clone 9.1-9.1 Heavy and Light Chain Variable Regions

In one specific embodiment, the anti-Galectin-9 antibody or antigen binding portion thereof comprises heavy and light chain variable regions, wherein: the light chain variable region CDR1, CDR2, and CDR3 comprise SEQ ID NO: 328, 329, and 330, respectively, and the heavy chain variable region CDR1, CDR2, and CDR3 comprise SEQ ID NO: 431, 438, and 367, respectively. In some embodiments, the light and heavy chain variable region CDR1, CDR2, and CDR3 consist of SEQ ID NO: 328, 329, and 330 and SEQ ID NO: 431, 438, and 367, respectively. In some embodiments, the antibody comprises the same VL and VH CDRs as G9.1-1.

In one specific embodiment, the anti-Galectin-9 antibody or binding portion thereof comprises heavy and light chain variable regions, wherein: the light chain variable region CDR1, CDR2, and CDR3 comprise SEQ ID NO: 328, 329, and 331, respectively, and the heavy chain variable region CDR1, CDR2, and CDR3 comprise SEQ ID NO: 435, 439, and 368, respectively. In some embodiments, the light and heavy chain variable region CDR1, CDR2, and CDR3 regions consist of SEQ ID NO: 328, 329, and 331 and SEQ ID NO: 435, 439, and 368. In one specific embodiment, the antibody comprises the same VL and VH CDRs as G9.1-2. In one specific embodiment, the anti-Galectin-9 antibody or binding portion thereof comprises heavy and light chain variable regions, wherein: the light chain variable region CDR1, CDR2, and CDR3 comprise SEQ ID NO: 328, 329, and 332, respectively, and the heavy chain variable region CDR1, CDR2, and CDR3 comprise SEQ ID NO: 436, 363, and 369, respectively. In some embodiments, the light and heavy chain variable region CDR1, CDR2, and CDR3 regions consist of SEQ ID NO: 328, 329, and 332 and SEQ ID NO: 436, 363, and 369. In one specific embodiment, the antibody comprises the same VL and VH CDRs as G9.1-3.

In one specific embodiment, the anti-Galectin-9 antibody or binding portion thereof comprises heavy and light chain variable regions, wherein: the light chain variable region CDR1, CDR2, and CDR3 comprise SEQ ID NO: 328, 329, and 333, respectively, and the heavy chain variable region CDR1, CDR2, and CDR3 comprise SEQ ID NO: 437, 440, and 370, respectively. In some embodiments, the light and heavy chain variable region CDR1, CDR2, and CDR3 regions consist of SEQ ID NO: 328, 329, and 333, and SEQ ID NO: 437, 440, and 370. In one specific embodiment, the antibody comprises the same VL and VH CDRs as G9.1-4.

In one specific embodiment, the anti-Galectin-9 antibody or binding portion thereof comprises heavy and light chain variable regions, wherein: the light chain variable region CDR1, CDR2, and CDR3 comprise SEQ ID NO: 328, 329, and 334, respectively, and the heavy chain variable region CDR1, CDR2, and CDR3 comprise SEQ ID NO: 437, 441, and 371, respectively. In some embodiments, the light and heavy chain variable region CDR1, CDR2, and CDR3 regions consist of SEQ ID NO: 328, 329, and 334, and SEQ ID NO: 437, 441, and 371. In one specific embodiment, the antibody comprises the same VL and VH CDRs as G9.1-5.

In one specific embodiment, the anti-Galectin-9 antibody or binding portion thereof comprises heavy and light chain variable regions, wherein: the light chain variable region CDR1, CDR2, and CDR3 comprise SEQ ID NO: 328, 329, and 335, respectively, and the heavy chain variable region CDR1, CDR2, and CDR3 comprise SEQ ID NO: 427, 442, and 372, respectively. In some embodiments, the light and heavy chain variable region CDR1, CDR2, and CDR3 regions consist of SEQ ID NO: 328, 329, and 335, and SEQ ID NO: 427, 442, and 372. In one specific embodiment, the antibody comprises the same VL and VH CDRs as G9.1-6.

In one specific embodiment, the anti-Galectin-9 antibody or binding portion thereof comprises heavy and light chain variable regions, wherein: the light chain variable region CDR1, CDR2, and CDR3 comprise SEQ ID NO: 328, 329, and 336, respectively, and the heavy chain variable region CDR1, CDR2, and CDR3 comprise SEQ ID NO: 361, 443, and 373, respectively. In some embodiments, the light and heavy chain variable region CDR1, CDR2, and CDR3 regions consist of SEQ ID NO: 328, 329, and 336, and SEQ ID NO: 361, 443, and 373. In one specific embodiment, the antibody comprises the same VL and VH CDRs as G9.1-7.

In one specific embodiment, the anti-Galectin-9 antibody or binding portion thereof comprises heavy and light chain variable regions, wherein: the light chain variable region CDR1, CDR2, and CDR3 comprise SEQ ID NO: 328, 329, and 337, respectively, and the heavy chain variable region CDR1, CDR2, and CDR3 comprise SEQ ID NO: 361, 364, and 374. In some embodiments, the light and heavy chain variable region CDR1, CDR2, and CDR3 regions consist of SEQ ID NO: 328, 329, and 337, and SEQ ID NO: 361, 364, and 374. In one specific embodiment, the antibody comprises the same VL and VH CDRs as G9.1-8.

In one specific embodiment, the anti-Galectin-9 antibody or binding portion thereof comprises heavy and light chain variable regions, wherein: the light chain variable region CDR1, CDR2, and CDR3 comprise SEQ ID NO: 328, 329, and 338, respectively, and the heavy chain variable region CDR1, CDR2, and CDR3 comprise SEQ ID NO: 361, 363, and 384. In some embodiments, the light and heavy chain variable region CDR1, CDR2, and CDR3 regions consist of SEQ ID NO: 328, 329, and 338, and SEQ ID NO: 361, 363, and 384. In one specific embodiment, the antibody comprises the same VL and VH CDRs as G9.1-9.

In one specific embodiment, the anti-Galectin-9 antibody or binding portion thereof comprises heavy and light chain variable regions, wherein: the light chain variable region CDR1, CDR2, and CDR3 comprise SEQ ID NO: 328, 329, and 339, respectively, and the heavy chain variable region CDR1, CDR2, and CDR3 comprise SEQ ID NO: 429, 444, and 385. In some embodiments, the light and heavy chain variable region CDR1, CDR2, and CDR3 regions consist of SEQ ID NO: 328, 329, and 339, and SEQ ID NO: 429, 444, and 385. In one specific embodiment, the antibody comprises the same VL and VH CDRs as G9.1-10.

In one specific embodiment, the anti-Galectin-9 antibody or binding portion thereof comprises heavy and light chain variable regions, wherein: the light chain variable region CDR1, CDR2, and CDR3 comprise SEQ ID NO: 328, 329, and 340, respectively, and the heavy chain variable region CDR1, CDR2, and CDR3 comprise SEQ ID NO: 428, 445, and 386. In some embodiments, the light and heavy chain variable region CDR1, CDR2, and CDR3 regions consist of SEQ ID NO: 328, 329, and 340, and SEQ ID NO: 428, 445, and 386. In one specific embodiment, the antibody comprises the same VL and VH CDRs as G9.1-11.

In one specific embodiment, the anti-Galectin-9 antibody or binding portion thereof comprises heavy and light chain variable regions, wherein: the light chain variable region CDR1, CDR2, and CDR3 comprise SEQ ID NO: 328, 329, and 337, respectively, and the heavy chain variable region CDR1, CDR2, and CDR3 comprise SEQ ID NO: 361, 365, and 374. In some embodiments, the light and heavy chain variable region CDR1, CDR2, and CDR3 regions consist of SEQ ID NO: 328, 329, and 337, and SEQ ID NO: 361, 365, and 374. In one specific embodiment, the antibody comprises the same VL and VH CDRs as G9.1-8m1.

In one specific embodiment, the anti-Galectin-9 antibody or binding portion thereof comprises heavy and light chain variable regions, wherein: the light chain variable region CDR1, CDR2, and CDR3 comprise SEQ ID NO: 328, 329, and 337, respectively, and the heavy chain variable region CDR1, CDR2, and CDR3 comprise SEQ ID NO: 361, 366, and 374. In some embodiments, the light and heavy chain variable region CDR1, CDR2, and CDR3 regions consist of SEQ ID NO: 328, 329, and 337, and SEQ ID NO: 361, 366, and 374. In one specific embodiment, the antibody comprises the same VL and VH CDRs as G9.1-8m2.

In one specific embodiment, the anti-Galectin-9 antibody or binding portion thereof comprises heavy and light chain variable regions, wherein: the light chain variable region CDR1, CDR2, and CDR3 comprise SEQ ID NO: 328, 329, and 337, respectively, and the heavy chain variable region CDR1, CDR2, and CDR3 comprise SEQ ID NO: 361, 364, and 375. In some embodiments, the light and heavy chain variable region CDR1, CDR2, and CDR3 regions consist of SEQ ID NO: 328, 329, and 337, and SEQ ID NO: 361, 364, and 375. In one specific embodiment, the antibody comprises the same VL and VH CDRs as G9.1-8m3.

In one specific embodiment, the anti-Galectin-9 antibody or binding portion thereof comprises heavy and light chain variable regions, wherein: the light chain variable region CDR1, CDR2, and CDR3 comprise SEQ ID NO: 328, 329, and 337, respectively, and the heavy chain variable region CDR1, CDR2, and CDR3 comprise SEQ ID NO: 361, 364, and 376. In some embodiments, the light and heavy chain variable region CDR1, CDR2, and CDR3 regions consist of SEQ ID NO: 328, 329, and 337, and SEQ ID NO: 361, 364, and 376. In one specific embodiment, the antibody comprises the same VL and VH CDRs as G9.1-8m4.

In one specific embodiment, the anti-Galectin-9 antibody or binding portion thereof comprises heavy and light chain variable regions, wherein: the light chain variable region CDR1, CDR2, and CDR3 comprise SEQ ID NO: 328, 329, and 337, respectively, and the heavy chain variable region CDR1, CDR2, and CDR3 comprise SEQ ID NO: 361, 364, and 377. In some embodiments, the light and heavy chain variable region CDR1, CDR2, and CDR3 regions consist of SEQ ID NO: 328, 329, and 337, and SEQ ID NO: 361, 364, and 377. In one specific embodiment, the antibody comprises the same VL and VH CDRs as G9.1-8m5.

In one specific embodiment, the anti-Galectin-9 antibody or binding portion thereof comprises heavy and light chain variable regions, wherein: the light chain variable region CDR1, CDR2, and CDR3 comprise SEQ ID NO: 328, 329, and 337, respectively, and the heavy chain variable region CDR1, CDR2, and CDR3 comprise SEQ ID NO: 361, 364, and 378. In some embodiments, the light and heavy chain variable region CDR1, CDR2, and CDR3 regions consist of SEQ ID NO: 328, 329, and 337, and SEQ ID NO: 361, 364, and 378. In one specific embodiment, the antibody comprises the same VL and VH CDRs as G9.1-8m6.

In one specific embodiment, the anti-Galectin-9 antibody or binding portion thereof comprises heavy and light chain variable regions, wherein: the light chain variable region CDR1, CDR2, and CDR3 comprise SEQ ID NO: 328, 329, and 337, respectively, and the heavy chain variable region CDR1, CDR2, and CDR3 comprise SEQ ID NO: 361, 364, and 379. In some embodiments, the light and heavy chain variable region CDR1, CDR2, and CDR3 regions consist of SEQ ID NO: 328, 329, and 337, and SEQ ID NO: 361, 364, and 379. In one specific embodiment, the antibody comprises the same VL and VH CDRs as G9.1-8m7.

In one specific embodiment, the anti-Galectin-9 antibody or binding portion thereof comprises heavy and light chain variable regions, wherein: the light chain variable region CDR1, CDR2, and CDR3 comprise SEQ ID NO: 328, 329, and 337, respectively, and the heavy chain variable region CDR1, CDR2, and CDR3 comprise SEQ ID NO: 361, 364, and 380. In some embodiments, the light and heavy chain variable region CDR1, CDR2, and CDR3 regions consist of SEQ ID NO: 328, 329, and 337, and SEQ ID NO: 361, 364, and 380. In one specific embodiment, the antibody comprises the same VL and VH CDRs as G9.1-8m8.

In one specific embodiment, the anti-Galectin-9 antibody or binding portion thereof comprises heavy and light chain variable regions, wherein: the light chain variable region CDR1, CDR2, and CDR3 comprise SEQ ID NO: 328, 329, and 337, respectively, and the heavy chain variable region CDR1, CDR2, and CDR3 comprise SEQ ID NO: 361, 364, and 383. In some embodiments, the light and heavy chain variable region CDR1, CDR2, and CDR3 regions consist of SEQ ID NO: 328, 329, and 337, and SEQ ID NO: 361, 364, and 383. In one specific embodiment, the antibody comprises the same VL and VH CDRs as G9.1-8m9.

In one specific embodiment, the anti-Galectin-9 antibody or binding portion thereof comprises heavy and light chain variable regions, wherein: the light chain variable region CDR1, CDR2, and CDR3 comprise SEQ ID NO: 328, 329, and 337, respectively, and the heavy chain variable region CDR1, CDR2, and CDR3 comprise SEQ ID NO: 361, 364, and 381. In some embodiments, the light and heavy chain variable region CDR1, CDR2, and CDR3 regions consist of SEQ ID NO: 328, 329, and 337, and SEQ ID NO: 361, 364, and 381. In one specific embodiment, the antibody comprises the same VL and VH CDRs as G9.1-8m10.

In one specific embodiment, the anti-Galectin-9 antibody or binding portion thereof comprises heavy and light chain variable regions, wherein: the light chain variable region CDR1, CDR2, and CDR3 comprise SEQ ID NO: 328, 329, and 337, respectively, and the heavy chain variable region CDR1, CDR2, and CDR3 comprise SEQ ID NO: 361, 364, and 382. In some embodiments, the light and heavy chain variable region CDR1, CDR2, and CDR3 regions consist of SEQ ID NO: 328, 329, and 337, and SEQ ID NO: 361, 364, and 382. In one specific embodiment, the antibody comprises the same VL and VH CDRs as G9.1-8m11.

In one specific embodiment, the anti-Galectin-9 antibody or binding portion thereof comprises heavy and light chain variable regions, wherein: the light chain variable region CDR1, CDR2, and CDR3 comprise SEQ ID NO: 328, 329, and 337, respectively, and the heavy chain variable region CDR1, CDR2, and CDR3 comprise SEQ ID NO: 361, 366, and 380. In some embodiments, the light and heavy chain variable region CDR1, CDR2, and CDR3 regions consist of SEQ ID NO: 328, 329, and 337, and SEQ ID NO: 361, 366, and 380. In one specific embodiment, the antibody comprises the same VL and VH CDRs as G9.1-8m12.

In one specific embodiment, the anti-Galectin-9 antibody or binding portion thereof comprises heavy and light chain variable regions, wherein: the light chain variable region CDR1, CDR2, and CDR3 comprise SEQ ID NO: 328, 329, and 337, respectively, and the heavy chain variable region CDR1, CDR2, and CDR3 comprise SEQ ID NO: 361, 366, and 383. In some embodiments, the light and heavy chain variable region CDR1, CDR2, and CDR3 regions consist of SEQ ID NO: 328, 329, and 337, and SEQ ID NO: 361, 366, and 383.

In one specific embodiment, the antibody comprises the same VL and VH CDRs as G9.1-8m13. In one specific embodiment, the anti-Galectin-9 antibody or binding portion thereof comprises heavy and light chain variable regions, wherein: the light chain variable region CDR1, CDR2, and CDR3 comprise SEQ ID NO: 328, 329, and 337, respectively, and the heavy chain variable region CDR1, CDR2, and CDR3 comprise SEQ ID NO: 361, 366, and 382, respectively. In some embodiments, the light and heavy chain variable region CDR1, CDR2, and CDR3 regions consist of SEQ ID NO: 328, 329, and 337, and SEQ ID NO: 361, 366, and 382. In one specific embodiment, the antibody comprises the same VL and VH CDRs as G9.1-8m14.

Sequence Identity

In some embodiments, the anti-Galectin-9 antibody (e.g., specific to CRD1 and/or CRD2) may comprise light chain CDRs that have at least 80% (e.g., 85%, 90%, 95%, 96%, 97%, 98%, 99% and any increment therein) sequence identity, individually or collectively, as compared with the corresponding VL CDRs of an exemplary antibody described herein. Alternatively or in addition, the anti-Galectin-9 antibody (e.g., specific to CRD1 or CRD2) may comprise heavy chain CDRs that have at least 80% (e.g., 85%, 90%, 95%, 96%, 97%, 98%, 99% and any increment therein) sequence identity, individually or collectively, as compared with the $V_H$ CDRs as an exemplary antibody described herein.

In some embodiments, the anti-Galectin-9 antibody (e.g., specific to CRD1 and/or CRD2) may comprise light chain CDRs that have at least 80% (e.g., 85%, 90%, 95%, 96%, 97%, 98%, 99% and any increment therein) sequence identity, individually or collectively, as compared with the corresponding VL CDRs of an antibody or antigen binding portion thereof selected from G9.1-1, G9.1-2, G9.1-3, G9.1-4, G9.1-5, G9.1-6, G9.1-7, G9.1-8, G9.1-9, G9.1-10, G9.1-11, G9.1-8m1, G9.1-8m2, G9.1-8m3, G9.1-8m4, G9.1-8m5, G9.1-8m6, G9.1-8m7, G9.1-8m8, G9.1-8m9, G9.1-8m10, G9.1-8m11, G9.1-8m12, G9.1-8m13, and G9.1-8m14. In some embodiments, the anti-Galectin-9 antibody (e.g., specific to CRD1 and/or CRD2) may comprise heavy chain CDRs that have at least 80% (e.g., 85%, 90%, 95%, 96%, 97%, 98%, 99% and any increment therein) sequence identity, individually or collectively, as compared with the corresponding VH CDRs of an antibody or antigen binding portion thereof selected from G9.1-1, G9.1-2, G9.1-3, G9.1-4, G9.1-5, G9.1-6, G9.1-7, G9.1-8, G9.1-9, G9.1-10, G9.1-11, G9.1-8m1, G9.1-8m2, G9.1-8m3, G9.1-8m4, G9.1-8m5, G9.1-8m6, G9.1-8m7, G9.1-8m8, G9.1-8m9, G9.1-8m10, G9.1-8m11, G9.1-8m12, G9.1-8m13, and G9.1-8m14.

In some embodiments, the anti-Galectin-9 antibody (e.g., specific to CRD1 and/or CRD2) may comprise light chain CDRs and heavy chain CDRs that have at least 80% (e.g., 85%, 90%, 95%, 96%, 97%, 98%, 99% and any increment therein) sequence identity, individually or collectively, as compared with the corresponding VL CDRs and VH CDRs of an antibody or antigen binding portion thereof selected from G9.1-1, G9.1-2, G9.1-3, G9.1-4, G9.1-5, G9.1-6, G9.1-7, G9.1-8, G9.1-9, G9.1-10, G9.1-11, G9.1-8m1, G9.1-8m2, G9.1-8m3, G9.1-8m4, G9.1-8m5, G9.1-8m6, G9.1-8m7, G9.1-8m8, G9.1-8m9, G9.1-8m10, G9.1-8m11, G9.1-8m12, G9.1-8m13, and G9.1-8m14.

In some embodiments, the anti-Galectin-9 antibody (e.g., specific to CRD1 and/or CRD2) may comprise a VL CDR1 amino acid sequence that has at least 80% (e.g., 85%, 90%, 95%, 96%, 97%, 98%, 99% and any increment therein) sequence identity to VL CDR1 amino acid sequence set forth in SEQ ID NO: 374. In some embodiments, the anti-Galectin-9 antibody (e.g., specific to CRD1 and/or CRD2) may comprise a VL CDR2 amino acid sequence that has at least 80% (e.g., 85%, 90%, 95%, 96%, 97%, 98%, 99% and any increment therein) sequence identity to the VL CDR2 amino acid sequence set forth in SEQ ID NO: 329. In some embodiments, the anti-Galectin-9 antibody (e.g., specific to CRD1 and/or CRD2) may comprise a VL CDR3 amino acid sequence that has at least 80% (e.g., 85%, 90%, 95%, 96%, 97%, 98%, 99% and any increment therein) sequence identity to a VL CDR3 amino acid sequence selected from SEQ ID NO: 330-340.

In some embodiments, the anti-Galectin-9 antibody (e.g., specific to CRD1 and/or CRD2) may comprise a VH CDR1 amino acid sequence that has at least 80% (e.g., 85%, 90%, 95%, 96%, 97%, 98%, 99% and any increment therein) sequence identity to a VH CDR1 amino acid sequence set forth in SEQ ID NO: 361, 427, 428, 431, 435, 436, 437. In some embodiments, the anti-Galectin-9 antibody (e.g., specific to CRD1 and/or CRD2) may comprise a VH CDR2 amino acid sequence that has at least 80% (e.g., 85%, 90%, 95%, 96%, 97%, 98%, 99% and any increment therein) sequence identity to a VH CDR2 amino acid sequence selected from SEQ ID NO: 362-366 and 438-445. In some embodiments, the anti-Galectin-9 antibody (e.g., specific to CRD1 and/or CRD2) may comprise a VH CDR3 amino acid sequence that has at least 80% (e.g., 85%, 90%, 95%, 96%, 97%, 98%, 99% and any increment therein) sequence identity to a VH CDR3 amino acid sequence selected from SEQ ID NO: 367-386.

Accordingly, in some embodiments, anti-Galectin-9 antibodies or antigen binding portions thereof comprise (a) VL CDR1 amino acid sequence that has at least 80% (e.g., 85%, 90%, 95%, 96%, 97%, 98%, 99% and any increment therein) sequence identity to the VL CDR1 amino acid sequence set forth in SEQ ID NO: 328; (b) VL CDR2 amino acid sequence that has at least 80% (e.g., 85%, 90%, 95%, 96%, 97%, 98%, 99% and any increment therein) sequence identity to the VL CDR2 amino acid sequence set forth in SEQ ID NO: 329; (c) VL CDR3 amino acid sequence that has at least 80% (e.g., 85%, 90%, 95%, 96%, 97%, 98%, 99% and any increment therein) sequence identity to a VL CDR3 amino acid sequence selected from SEQ ID NO: 330-340; (d) VH CDR1 amino acid sequence that has at least 80% (e.g., 85%, 90%, 95%, 96%, 97%, 98%, 99% and any increment therein) sequence identity to the VH CDR1 amino acid sequence set forth in SEQ ID NO: 361, 427, 428, 431, 435, 436, 437; (e) VH CDR2 amino acid sequence that has at least 80% (e.g., 85%, 90%, 95%, 96%, 97%, 98%, 99% and any increment therein) sequence identity to a VH CDR2 amino acid sequence selected from SEQ ID NO: 362-366 and 438-445; (f) VH CDR3 amino acid sequence that has at least 80% (e.g., 85%, 90%, 95%, 96%, 97%, 98%, 99% and any increment therein) sequence identity to a VH CDR3 amino acid sequence selected from SEQ ID NO: 367-386.

In some embodiments, the anti-Galectin-9 antibody or binding portion thereof comprises heavy and light chain variable regions, wherein the light chain variable region CDR1, CDR2, and CDR3 amino acid sequences have at least 80% (e.g., 85%, 90%, 95%, 96%, 97%, 98%, 99% and any increment therein) sequence identity to the light chain variable region CDR1, CDR2, and CDR3 amino acid sequences set forth in SEQ ID NO: 328, 329, and 337, respectively. In some embodiments, the antibody VL CDR1, CDR2, and CDR3 amino acid sequences have at least 80% (e.g., 85%, 90%, 95%, 96%, 97%, 98%, 99% and any increment therein) sequence identity to the VL CDR1, CDR2, and CDR3 amino acid sequences of G9.1-8m13. In some embodiments, the anti-Galectin-9 antibody or binding portion thereof comprises heavy and light chain variable regions, wherein the heavy chain variable region CDR1, CDR2, and CDR3 amino acid sequences have at least 80% (e.g., 85%, 90%, 95%, 96%, 97%, 98%, 99% and any increment therein) sequence identity to the heavy chain variable region CDR1, CDR2, and CDR3 amino acid sequences set forth in SEQ ID NO: 361, 366, and 383. In some embodiments, the antibody VH CDR1, CDR2, and CDR3 amino acid sequences have at least 80% (e.g., 85%, 90%, 95%, 96%, 97%, 98%, 99% and any increment therein) sequence identity to the VH CDR1, CDR2, and CDR3 amino acid sequences of G9.1-8m13. In one specific embodiment, the anti-Galectin-9 antibody or binding portion thereof comprises heavy and light chain variable regions, wherein: the light chain variable region CDR1, CDR2, and CDR3 amino acid sequences have at least 80% (e.g., 85%, 90%, 95%, 96%, 97%, 98%, 99% and any increment therein) sequence identity to the light chain variable region CDR1, CDR2, and CDR3 amino acid sequences set forth in SEQ ID NO: 328, 329, and 337, respectively, and the heavy chain variable region CDR1, CDR2, and CDR3 amino acid sequences have at least 80% (e.g., 85%, 90%, 95%, 96%, 97%, 98%, 99% and any increment therein) sequence identity to the heavy chain variable region CDR1, CDR2, and CDR3 amino acid sequences set forth in SEQ ID NO: 361, 366, and 383. In one specific embodiment, the antibody VL CDR1, CDR2, and CDR3 and VH CDR1, CDR2, and CDR3 amino acid sequences have at least 80% (e.g., 85%, 90%, 95%, 96%, 97%, 98%, 99% and any increment therein)

sequence identity to the VL CDR1, CDR2, and CDR3 and VH CDR1, CDR2, and CDR3 amino acid sequences as G9.1-8m13.

9.2 Antibody Clones and Related CDRs

Clone 9.2-Derived Light Chain Variable Region

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 341, respectively. In some embodiments, the light chain variable region CDR1, CDR2, and CDR3 regions consist of SEQ ID NO: 328, 329, and 341, respectively. In some embodiments, the antibody comprises the same VL CDRs as G9.2-1.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 333, respectively. In some embodiments, the light chain variable region CDR1, CDR2, and CDR3 regions consist of SEQ ID NO: 328, 329, and 333, respectively. In some embodiments, the antibody comprises the same VL CDRs as G9.2-2.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 333, respectively. In some embodiments, the light chain variable region CDR1, CDR2, and CDR3 regions consist of SEQ ID NO: 328, 329, and 333, respectively. In some embodiments, the antibody comprises the same VL CDRs as G9.2-3.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 342, respectively. In some embodiments, the light chain variable region CDR1, CDR2, and CDR3 regions consist of SEQ ID NO: 328, 329, and 342, respectively. In some embodiments, the antibody comprises the same VL CDRs as G9.2-4.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 343, respectively. In some embodiments, the light chain variable region CDR1, CDR2, and CDR3 regions consist of SEQ ID NO: 328, 329, and 343, respectively. In some embodiments, the antibody comprises the same VL CDRs as G9.2-5.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 344, respectively. In some embodiments, the light chain variable region CDR1, CDR2, and CDR3 regions consist of SEQ ID NO: 328, 329, and 344, respectively. In some embodiments, the antibody comprises the same VL CDRs as G9.2-6.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 345, respectively. In some embodiments, the light chain variable region CDR1, CDR2, and CDR3 regions consist of SEQ ID NO: 328, 329, and 345, respectively. In some embodiments, the antibody comprises the same VL CDRs as G9.2-7.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 346, respectively. In some embodiments, the light chain variable region CDR1, CDR2, and CDR3 regions consist of SEQ ID NO: 328, 329, and 346. In some embodiments, the antibody comprises the same VL CDRs as G9.2-8.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 347, respectively. In some embodiments, the light chain variable region CDR1, CDR2, and CDR3 regions consist of SEQ ID NO: 328, 329, and 347, respectively. In some embodiments, the antibody comprises the same VL CDRs as G9.2-9.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 348, respectively. In some embodiments, the light chain variable region CDR1, CDR2, and CDR3 regions consist of SEQ ID NO: 328, 329, and 348, respectively. In some embodiments, the antibody comprises the same VL CDRs as G9.2-10.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 349, respectively. In some embodiments, the light chain variable region CDR1, CDR2, and CDR3 regions consist of SEQ ID NO: 328, 329, and 349, respectively. In some embodiments, the antibody comprises the same VL CDRs as G9.2-11.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 350, respectively. In some embodiments, the light chain variable region CDR1, CDR2, and CDR3 regions consist of SEQ ID NO: 328, 329, and 350, respectively. In some embodiments, the antibody comprises the same VL CDRs as G9.2-12.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 341, respectively. In some embodiments, the light chain variable region CDR1, CDR2, and CDR3 regions consist of SEQ ID NO: 328, 329, and 341. In some embodiments, the antibody comprises the same VL CDRs as G9.2-13.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 333, respectively. In some embodiments, the light chain variable region CDR1, CDR2, and CDR3 regions consist of SEQ ID NO: 328, 329, and 333, respectively. In some embodiments, the antibody comprises the same VL CDRs as G9.2-14.

In some embodiments, the anti-Galectin-9 antibody or binding portion thereof comprises heavy and light chain variable regions, wherein the light chain variable region CDR1, CDR2, and CDR3 regions comprise SEQ ID NO:

328, 329, and 343, respectively. In some embodiments, the light chain variable region CDR1, CDR2, and CDR3 regions consist of SEQ ID NO: 328, 329, and 343, respectively. In some embodiments, the antibody comprises the same VL CDRs as G9.2-15.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 333, respectively. In some embodiments, the light chain variable region CDR1, CDR2, and CDR3 regions consist of SEQ ID NO: 328, 329, and 333. In some embodiments, the antibody comprises the same VL CDRs as G9.2-16.

In some embodiments, the anti-Galectin-9 antibody or binding portion thereof comprises heavy and light chain variable regions, wherein the light chain variable region CDR1 comprises SEQ ID NO: 328. In some embodiments, the anti-Galectin-9 antibody or binding portion thereof comprises heavy and light chain variable regions, wherein the light chain variable region CDR2 comprises SEQ ID NO: 329. In some embodiments, the anti-Galectin-9 antibody or binding portion thereof comprises heavy and light chain variable regions, wherein the light chain variable region CDR3 comprises SEQ ID NO: 352. In some embodiments, the anti-Galectin-9 antibody or binding portion thereof comprises heavy and light chain variable regions, wherein the light chain variable region CDR1 consists of SEQ ID NO: 328. In some embodiments, the anti-Galectin-9 antibody or binding portion thereof comprises heavy and light chain variable regions, wherein the light chain variable region CDR2 consists of SEQ ID NO: 329. In some embodiments, the anti-Galectin-9 antibody or binding portion thereof consists of heavy and light chain variable regions, wherein the light chain variable region CDR3 comprises SEQ ID NO: 352. In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 352, respectively. In some embodiments, the light chain variable region CDR1, CDR2, and CDR3 regions consist of SEQ ID NO: 328, 329, and 352, respectively. In some embodiments, the antibody comprises the same VL CDRs as G9.2-17.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 352, respectively. In some embodiments, the light chain variable region CDR1, CDR2, and CDR3 regions consist of SEQ ID NO: 328, 329, and 352, respectively. In some embodiments, the antibody comprises the same VL CDRs as G9.2-17mut6.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 333, respectively. In some embodiments, the light chain variable region CDR1, CDR2, and CDR3 regions consist of SEQ ID NO: 328, 329, and 333, respectively. In some embodiments, the antibody comprises the same VL CDRs as G9.2-18.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 354, respectively. In some embodiments, the light chain variable region CDR1, CDR2, and CDR3 regions consist of SEQ ID NO: 328, 329, and 354. In some embodiments, the antibody comprises the same VL CDRs as G9.2-19.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 352, respectively. In some embodiments, the light chain variable region CDR1, CDR2, and CDR3 regions consist of SEQ ID NO: 328, 329, and 352, respectively. In some embodiments, the antibody comprises the same VL CDRs as G9.2-20.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 355, respectively. In some embodiments, the light chain variable region CDR1, CDR2, and CDR3 regions consist of SEQ ID NO: 328, 329, and 355, respectively. In some embodiments, the antibody comprises the same VL CDRs as G9.2-21.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 356, respectively. In some embodiments, the light chain variable region CDR1, CDR2, and CDR3 regions consist of SEQ ID NO: 328, 329, and 356, respectively. In some embodiments, the antibody comprises the same VL CDRs as G9.2-22.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 357, respectively. In some embodiments, the light chain variable region CDR1, CDR2, and CDR3 regions consist of SEQ ID NO: 328, 329, and 357, respectively. In some embodiments, the antibody comprises the same VL CDRs as G9.2-23.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 358, respectively. In some embodiments, the light chain variable region CDR1, CDR2, and CDR3 regions consist of SEQ ID NO: 328, 329, and 358, respectively. In some embodiments, the antibody comprises the same VL CDRs as G9.2-24.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 359, respectively. In some embodiments, the light chain variable region CDR1, CDR2, and CDR3 regions consist of SEQ ID NO: 328, 329, and 359, respectively. In some embodiments, the antibody comprises the same VL CDRs as G9.2-25.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 360, respectively. In some embodiments, the light chain variable region CDR1, CDR2, and CDR3 regions consist of SEQ ID NO: 328, 329, and 360, respectively. In some embodiments, the antibody comprises the same VL CDRs as G9.2-26.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 352, respectively. In some embodiments, the light chain variable region CDR1, CDR2, and CDR3 regions consist of SEQ ID NO: 328, 329, and 352, respectively. In some embodiments, the antibody comprises the same VL CDRs as G9.2-low affinity binder.

Clone 9.2-Derived Heavy Chain Variable Region

In some embodiments, the anti-Galectin-9 antibody or binding portion thereof comprises heavy and light chain variable regions, wherein the heavy chain variable region CDR1, CDR2, and CDR3 regions comprise SEQ ID NO: 424, 446, and 390, respectively. In some embodiments, the heavy chain variable region CDR1, CDR2, and CDR3 regions consist of SEQ ID NO: 424, 446, and 390, respectively. In some embodiments, the antibody comprises the same VH CDRs as G9.2-1.

In some embodiments, the anti-Galectin-9 antibody or binding portion thereof comprises heavy and light chain variable regions, wherein the heavy chain variable region CDR1, CDR2, and CDR3 regions comprise SEQ ID NO: 431, 447, and 391, respectively. In some embodiments, the heavy chain variable region CDR1, CDR2, and CDR3 regions consist of SEQ ID NO: 431, 447, and 391, respectively. In some embodiments, the antibody comprises the same VH CDRs as G9.2-2.

In some embodiments, the anti-Galectin-9 antibody or binding portion thereof comprises heavy and light chain variable regions, wherein the heavy chain variable region CDR1, CDR2, and CDR3 regions comprise SEQ ID NO: 431, 448, and 392, respectively. In some embodiments, the heavy chain variable region CDR1, CDR2, and CDR3 regions consist of SEQ ID NO: 431, 448, and 392. In some embodiments, the antibody comprises the same VH CDRs as G9.2-3.

In some embodiments, the anti-Galectin-9 antibody or binding portion thereof comprises heavy and light chain variable regions, wherein the heavy chain variable region CDR1, CDR2, and CDR3 regions comprise SEQ ID NO: 431, 449, and 393, respectively. In some embodiments, the heavy chain variable region CDR1, CDR2, and CDR3 regions consist of SEQ ID NO: 431, 449, and 393, respectively. In some embodiments, the antibody comprises the same VH CDRs as G9.2-4.

In some embodiments, the anti-Galectin-9 antibody or binding portion thereof comprises heavy and light chain variable regions, wherein the heavy chain variable region CDR1, CDR2, and CDR3 regions comprise SEQ ID NO: 431, 450, and 394, respectively. In some embodiments, the heavy chain variable region CDR1, CDR2, and CDR3 regions consist of SEQ ID NO: 431, 450, and 394, respectively. In some embodiments, the antibody comprises the same VH CDRs as G9.2-5.

In some embodiments, the anti-Galectin-9 antibody or binding portion thereof comprises heavy and light chain variable regions, wherein the heavy chain variable region CDR1, CDR2, and CDR3 regions comprise SEQ ID NO: 431, 451, and 395, respectively. In some embodiments, the heavy chain variable region CDR1, CDR2, and CDR3 regions consist of SEQ ID NO: 431, 452, and 395. In some embodiments, the antibody comprises the same VH CDRs as G9.2-6.

In some embodiments, the anti-Galectin-9 antibody or binding portion thereof comprises heavy and light chain variable regions, wherein the heavy chain variable region CDR1, CDR2, and CDR3 regions comprise SEQ ID NO: 425, 453, and 396, respectively. In some embodiments, the heavy chain variable region CDR1, CDR2, and CDR3 regions consist of SEQ ID NO: 425, 453, and 396, respectively. In some embodiments, the antibody comprises the same VH CDRs as G9.2-7.

In some embodiments, the anti-Galectin-9 antibody or binding portion thereof comprises heavy and light chain variable regions, wherein the heavy chain variable region CDR1, CDR2, and CDR3 regions comprise SEQ ID NO: 425, 453, and 397, respectively. In some embodiments, the heavy chain variable region CDR1, CDR2, and CDR3 regions consist of SEQ ID NO: 425, 453, and 397, respectively. In some embodiments, the antibody comprises the same VH CDRs as G9.2-8.

In some embodiments, the anti-Galectin-9 antibody or binding portion thereof comprises heavy and light chain variable regions, wherein the heavy chain variable region CDR1, CDR2, and CDR3 regions comprise SEQ ID NO: 426, 454, and 398, respectively. In some embodiments, the heavy chain variable region CDR1, CDR2, and CDR3 regions consist of SEQ ID NO: 426, 454, and 398, respectively. In some embodiments, the antibody comprises the same VH CDRs as G9.2-9.

In some embodiments, the anti-Galectin-9 antibody or binding portion thereof comprises heavy and light chain variable regions, wherein the heavy chain variable region CDR1, CDR2, and CDR3 regions comprise SEQ ID NO: 426, 387, and 399, respectively. In some embodiments, the heavy chain variable region CDR1, CDR2, and CDR3 regions consist of SEQ ID NO: 426, 387, and 399, respectively. In some embodiments, the antibody comprises the same VH CDRs as G9.2-10.

In some embodiments, the anti-Galectin-9 antibody or binding portion thereof comprises heavy and light chain variable regions, wherein the heavy chain variable region CDR1, CDR2, and CDR3 regions comprise SEQ ID NO: 432, 455, and 400, respectively. In some embodiments, the heavy chain variable region CDR1, CDR2, and CDR3 regions consist of SEQ ID NO: 432, 455, and 400, respectively. In some embodiments, the antibody comprises the same VH CDRs as G9.2-11.

In some embodiments, the anti-Galectin-9 antibody or binding portion thereof comprises heavy and light chain variable regions, wherein the heavy chain variable region CDR1, CDR2, and CDR3 regions comprise SEQ ID NO: 433, 456, and 401, respectively. In some embodiments, the heavy chain variable region CDR1, CDR2, and CDR3 regions consist of SEQ ID NO: 433, 456, and 401, respectively. In some embodiments, the antibody comprises the same VH CDRs as G9.2-12.

In some embodiments, the anti-Galectin-9 antibody or binding portion thereof comprises heavy and light chain variable regions, wherein the heavy chain variable region CDR1, CDR2, and CDR3 regions comprise SEQ ID NO: 434, 362, and 402, respectively. In some embodiments, the heavy chain variable region CDR1, CDR2, and CDR3 regions consist of SEQ ID NO: 434, 362, and 402, respectively. In some embodiments, the antibody comprises the same VH CDRs as G9.2-13.

In some embodiments, the anti-Galectin-9 antibody or binding portion thereof comprises heavy and light chain variable regions, wherein the heavy chain variable region CDR1, CDR2, and CDR3 regions comprise SEQ ID NO: 361, 457, and 403, respectively. In some embodiments, the heavy chain variable region CDR1, CDR2, and CDR3 regions consist of SEQ ID NO: 361, 457, and 403, respectively. In some embodiments, the antibody comprises the same VH CDRs as G9.2-14.

In some embodiments, the anti-Galectin-9 antibody or binding portion thereof comprises heavy and light chain variable regions, wherein the heavy chain variable region CDR1, CDR2, and CDR3 regions comprise SEQ ID NO: 361, 458, and 404, respectively. In some embodiments, the heavy chain variable region CDR1, CDR2, and CDR3 regions consist of SEQ ID NO: 361, 458, and 404, respectively. In some embodiments, the antibody comprises the same VH CDRs as G9.2-15.

In some embodiments, the anti-Galectin-9 antibody or binding portion thereof comprises heavy and light chain variable regions, wherein the heavy chain variable region CDR1, CDR2, and CDR3 regions comprise SEQ ID NO: 361, 459, and 405, respectively. In some embodiments, the heavy chain variable region CDR1, CDR2, and CDR3 regions consist of SEQ ID NO: 361, 459, and 405, respectively. In some embodiments, the antibody comprises the same VH CDRs as G9.2-16.

In some embodiments, the anti-Galectin-9 antibody or binding portion thereof comprises heavy and light chain variable regions, wherein the heavy chain variable region CDR1, CDR2, and CDR3 regions comprise SEQ ID NO: 361, 388, and 406, respectively. In some embodiments, the heavy chain variable region CDR1, CDR2, and CDR3 regions consist of SEQ ID NO: 361, 388, and 406. In some embodiments, the antibody comprises the same VH CDRs as G9.2-17.

In some embodiments, the anti-Galectin-9 antibody or binding portion thereof comprises heavy and light chain variable regions, wherein the heavy chain variable region CDR1, CDR2, and CDR3 regions comprise SEQ ID NO: 361, 388, and 407, respectively. In some embodiments, the heavy chain variable region CDR1, CDR2, and CDR3 regions consist of SEQ ID NO: 361, 388, and 407, respectively. In some embodiments, the antibody comprises the same VH CDRs as G9.2-17mut6.

In some embodiments, the anti-Galectin-9 antibody or binding portion thereof comprises heavy and light chain variable regions, wherein the heavy chain variable region CDR1, CDR2, and CDR3 regions comprise SEQ ID NO: 430, 363, and 408, respectively. In some embodiments, the heavy chain variable region CDR1, CDR2, and CDR3 regions consist of SEQ ID NO: 430, 363, and 408, respectively. In some embodiments, the antibody comprises the same VH CDRs as G9.2-18.

In some embodiments, the anti-Galectin-9 antibody or binding portion thereof comprises heavy and light chain variable regions, wherein the heavy chain variable region CDR1, CDR2, and CDR3 regions comprise SEQ ID NO: 430, 460, and 409, respectively. In some embodiments, the heavy chain variable region CDR1, CDR2, and CDR3 regions consist of SEQ ID NO: 430, 460, and 409, respectively. In some embodiments, the antibody comprises the same VH CDRs as G9.2-19.

In some embodiments, the anti-Galectin-9 antibody or binding portion thereof comprises heavy and light chain variable regions, wherein the heavy chain variable region CDR1, CDR2, and CDR3 regions comprise SEQ ID NO: 429, 461, and 410, respectively. In some embodiments, the heavy chain variable region CDR1, CDR2, and CDR3 regions consist of SEQ ID NO: 429, 461, and 410, respectively. In some embodiments, the antibody comprises the same VH CDRs as G9.2-20.

In some embodiments, the anti-Galectin-9 antibody or binding portion thereof comprises heavy and light chain variable regions, wherein the heavy chain variable region CDR1, CDR2, and CDR3 regions comprise SEQ ID NO: 429, 462, and 411, respectively. In some embodiments, the heavy chain variable region CDR1, CDR2, and CDR3 regions consist of SEQ ID NO: 429, 462, and 411, respectively. In some embodiments, the antibody comprises the same VH CDRs as G9.2-21.

In some embodiments, the anti-Galectin-9 antibody or binding portion thereof comprises heavy and light chain variable regions, wherein the heavy chain variable region CDR1, CDR2, and CDR3 regions comprise SEQ ID NO: 428, 463, and 412, respectively. In some embodiments, the heavy chain variable region CDR1, CDR2, and CDR3 regions consist of SEQ ID NO: 428, 463, and 412, respectively. In some embodiments, the antibody comprises the same VH CDRs as G9.2-22.

In some embodiments, the anti-Galectin-9 antibody or binding portion thereof comprises heavy and light chain variable regions, wherein the heavy chain variable region CDR1, CDR2, and CDR3 regions comprise SEQ ID NO: 428, 464, and 413, respectively. In some embodiments, the heavy chain variable region CDR1, CDR2, and CDR3 regions consist of SEQ ID NO: 428, 464, and 413, respectively. In some embodiments, the antibody comprises the same VH CDRs as G9.2-23.

In some embodiments, the anti-Galectin-9 antibody or binding portion thereof comprises heavy and light chain variable regions, wherein the heavy chain variable region CDR1, CDR2, and CDR3 regions comprise SEQ ID NO: 428, 465, and 414, respectively. In some embodiments, the heavy chain variable region CDR1, CDR2, and CDR3 regions consist of SEQ ID NO: 428, 465, and 414, respectively. In some embodiments, the antibody comprises the same VH CDRs as G9.2-24.

In some embodiments, the anti-Galectin-9 antibody or binding portion thereof comprises heavy and light chain variable regions, wherein the heavy chain variable region CDR1, CDR2, and CDR3 regions comprise SEQ ID NO: 427, 466, and 415, respectively. In some embodiments, the heavy chain variable region CDR1, CDR2, and CDR3 regions consist of SEQ ID NO: 427, 466, and 415. In some embodiments, the antibody comprises the same VH CDRs as G9.2-25.

In some embodiments, the anti-Galectin-9 antibody or binding portion thereof comprises heavy and light chain variable regions, wherein the heavy chain variable region CDR1, CDR2, and CDR3 regions comprise SEQ ID NO: 361, 389, and 416, respectively. In some embodiments, the heavy chain variable region CDR1, CDR2, and CDR3 regions consist of SEQ ID NO: 361, 389, and 416, respectively. In some embodiments, the antibody comprises the same VH CDRs as G9.2-26.

In some embodiments, the anti-Galectin-9 antibody or binding portion thereof comprises heavy and light chain variable regions, wherein the heavy chain variable region CDR1, CDR2, and CDR3 regions comprise SEQ ID NO: 361, 388, and 417, respectively. In some embodiments, the heavy chain variable region CDR1, CDR2, and CDR3 regions consist of SEQ ID NO: 361, 388, and 417, respectively. In some embodiments, the antibody comprises the same VH CDRs as G9.2-low affinity binder.

Clone 9.2-Derived Heavy and Light Chain Variable Regions

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 341, respectively, and the heavy chain variable region CDR1, CDR2, and CDR3 comprise SEQ ID NO: 424, 446, and 390 respectively. In some embodiments, the light and heavy chain variable region CDR1, CDR2, and CDR3 regions consist of SEQ ID NO: 328, 329, and 341, and SEQ ID NO: 424, 446, and 390. In one specific embodiment, the antibody comprises the same VL and VH CDRs as G9.2-1.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 333, respectively, and the heavy chain variable region CDR1, CDR2, and CDR3 comprise SEQ ID NO: 431, 447, and 391, respectively. In some embodiments, the light and heavy chain variable region CDR1, CDR2, and CDR3 regions consist of SEQ ID NO: 328, 329, and 333, and SEQ ID NO: 431, 447, and 391. In one specific embodiment, the antibody comprises the same VL and VH CDRs as G9.2-2.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 333, respectively, and the heavy chain variable region CDR1, CDR2, and CDR3 comprise SEQ ID NO: 431, 448, and 392, respectively. In some embodiments, the light and heavy chain variable region CDR1, CDR2, and CDR3 regions consist of SEQ ID NO: 328, 329, and 333, and SEQ ID NO: 431, 448, and 392. In one specific embodiment, the antibody comprises the same VL and VH CDRs as G9.2-3.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 342, respectively, and the heavy chain variable region CDR1, CDR2, and CDR3 comprise SEQ ID NO: 431, 449, and 393, respectively. In some embodiments, the light and heavy chain variable region CDR1, CDR2, and CDR3 regions consist of SEQ ID NO: 328, 329, and 342, and SEQ ID NO: 431, 449, and 393. In one specific embodiment, the antibody comprises the same VL and VH CDRs as G9.2-4.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 343, respectively, and the heavy chain variable region CDR1, CDR2, and CDR3 comprise SEQ ID NO: 431, 450, and 394, respectively. In some embodiments, the light and heavy chain variable region CDR1, CDR2, and CDR3 regions consist of SEQ ID NO: 328, 329, and 343, and SEQ ID NO: 431, 450, and 394. In one specific embodiment, the antibody comprises the same VL and VH CDRs as G9.2-5.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 344, respectively, and the heavy chain variable region CDR1, CDR2, and CDR3 comprise SEQ ID NO: 431, 451, and 395, respectively. In some embodiments, the light and heavy chain variable region CDR1, CDR2, and CDR3 regions consist of SEQ ID NO: 328, 329, and 344, and SEQ ID NO: 431, 451, and 395. In one specific embodiment, the antibody comprises the same VL and VH CDRs as G9.2-6.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 345, respectively, and the heavy chain variable region CDR1, CDR2, and CDR3 comprise SEQ ID NO: 425, 452, and 396, respectively. In some embodiments, the light and heavy chain variable region CDR1, CDR2, and CDR3 regions consist of SEQ ID NO: 328, 329, and 345, and SEQ ID NO: 425, 452, and 396. In one specific embodiment, the antibody comprises the same VL and VH CDRs as G9.2-7.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 346, respectively, and the heavy chain variable region CDR1, CDR2, and CDR3 comprise SEQ ID NO: 245, 453, and 397, respectively. In some embodiments, the light and heavy chain variable region CDR1, CDR2, and CDR3 regions consist of SEQ ID NO: 328, 329, and 346, and SEQ ID NO: 245, 453, and 397. In one specific embodiment, the antibody comprises the same VL and VH CDRs as G9.2-8.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 347, respectively, and the heavy chain variable region CDR1, CDR2, and CDR3 comprise SEQ ID NO: 426, 454, and 398, respectively. In some embodiments, the light and heavy chain variable region CDR1, CDR2, and CDR3 regions consist of SEQ ID NO: 328, 329, and 347, and SEQ ID NO: 426, 454, and 398. In one specific embodiment, the antibody comprises the same VL and VH CDRs as G9.2-9.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 348, respectively, and the heavy chain variable region CDR1, CDR2, and CDR3 comprise SEQ ID NO: 426, 387, and 399, respectively. In some embodiments, the light and heavy chain variable region CDR1, CDR2, and CDR3 regions consist of SEQ ID NO: 328, 329, and 348, and SEQ ID NO: 426, 387, and 399. In one specific embodiment, the antibody comprises the same VL and VH CDRs as G9.2-10.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 349, respectively, and the heavy chain variable region CDR1, CDR2, and CDR3 comprise SEQ ID NO: 432, 455, and 400, respectively. In some embodiments, the light and heavy chain variable region CDR1, CDR2, and CDR3 regions consist of SEQ ID NO: 328, 329, and 349, and SEQ ID NO: 432, 455, and 400. In one specific embodiment, the antibody comprises the same VL and VH CDRs as G9.2-11.

In some embodiments, the anti-Galectin-9 antibody or binding portion thereof comprises heavy and light chain variable regions, wherein the light chain variable region CDR1, CDR2, and CDR3 regions comprise SEQ ID NO:

328, 329, and 350, respectively, and the heavy chain variable region CDR1, CDR2, and CDR3 comprise SEQ ID NO: 433, 456, and 401, respectively. In some embodiments, the light and heavy chain variable region CDR1, CDR2, and CDR3 regions consist of SEQ ID NO: 328, 329, and 350, and SEQ ID NO: 433, 456, and 401. In one specific embodiment, the antibody comprises the same VL and VH CDRs as G9.2-12.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 341, respectively, and the heavy chain variable region CDR1, CDR2, and CDR3 comprise SEQ ID NO: 434, 362, and 402, respectively. In some embodiments, the light and heavy chain variable region CDR1, CDR2, and CDR3 regions consist of SEQ ID NO: 328, 329, and 341, and SEQ ID NO: 434, 362, and 402. In one specific embodiment, the antibody comprises the same VL and VH CDRs as G9.2-13.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 333, respectively, and the heavy chain variable region CDR1, CDR2, and CDR3 comprise SEQ ID NO: 361, 457, and 403, respectively. In some embodiments, the light and heavy chain variable region CDR1, CDR2, and CDR3 regions consist of SEQ ID NO: 328, 329, and 333, and SEQ ID NO: 361, 457, and 403. In one specific embodiment, the antibody comprises the same VL and VH CDRs as G9.2-14.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 343, respectively, and the heavy chain variable region CDR1, CDR2, and CDR3 comprise SEQ ID NO: 361, 458, and 404, respectively. In some embodiments, the light and heavy chain variable region CDR1, CDR2, and CDR3 regions consist of SEQ ID NO: 328, 329, and 343, and SEQ ID NO: 361, 458, and 404. In one specific embodiment, the antibody comprises the same VL and VH CDRs as G9.2-15.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 333, respectively, and the heavy chain variable region CDR1, CDR2, and CDR3 comprise SEQ ID NO: 361, 459, and 405, respectively. In some embodiments, the light and heavy chain variable region CDR1, CDR2, and CDR3 regions consist of SEQ ID NO: 328, 329, and 333, and SEQ ID NO: 361, 459, and 405. In one specific embodiment, the antibody comprises the same VL and VH CDRs as G9.2-16.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 352, respectively, and the heavy chain variable region CDR1, CDR2, and CDR3 comprise SEQ ID NO: 361, 388, and 406, respectively. In some embodiments, the light and heavy chain variable region CDR1, CDR2, and CDR3 regions consist of SEQ ID NO: 328, 329, and 352, and SEQ ID NO: 361, 388, and 406. In one specific embodiment, the antibody comprises the same VL and VH CDRs as G9.2-17.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 352, respectively, and the heavy chain variable region CDR1, CDR2, and CDR3 comprise SEQ ID NO: 361, 388, and 404, respectively. In some embodiments, the light and heavy chain variable region CDR1, CDR2, and CDR3 regions consist of SEQ ID NO: 328, 329, and 352, and SEQ ID NO: 361, 388, and 404. In one specific embodiment, the antibody comprises the same VL and VH CDRs as G9.2-17mut6.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 333, respectively, and the heavy chain variable region CDR1, CDR2, and CDR3 comprise SEQ ID NO: 430, 363, and 408, respectively. In some embodiments, the light and heavy chain variable region CDR1, CDR2, and CDR3 regions consist of SEQ ID NO: 328, 329, and 333, and SEQ ID NO: 430, 363, and 408. In one specific embodiment, the antibody comprises the same VL and VH CDRs as G9.2-18.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 354, respectively, and the heavy chain variable region CDR1, CDR2, and CDR3 comprise SEQ ID NO: 430, 460, and 409, respectively. In some embodiments, the light and heavy chain variable region CDR1, CDR2, and CDR3 regions consist of SEQ ID NO: 328, 329, and 354, and SEQ ID NO: 430, 460, and 409. In one specific embodiment, the antibody comprises the same VL and VH CDRs as G9.2-19.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 352, respectively, and the heavy chain variable region CDR1, CDR2, and CDR3 comprise SEQ ID NO: 429, 461, and 410, respectively. In some embodiments, the light and heavy chain variable region CDR1, CDR2, and CDR3 regions consist of SEQ ID NO: 328, 329, and 352, and SEQ ID NO: 429, 461, and 410. In one specific embodiment, the antibody comprises the same VL and VH CDRs as G9.2-20.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 355, respectively, and the heavy chain variable region CDR1, CDR2, and CDR3 comprise SEQ ID NO: 429, 462, and 411, respectively. In some embodiments, the light and heavy chain variable region CDR1, CDR2, and CDR3 regions consist of SEQ ID NO: 328, 329, and 355, and SEQ ID NO: 429, 462, and 411. In one specific embodiment, the antibody comprises the same VL and VH CDRs as G9.2-21.

In some embodiments, the anti-Galectin-9 antibody or binding portion thereof comprises heavy and light chain variable regions, wherein the light chain variable region CDR1, CDR2, and CDR3 regions comprise SEQ ID NO:

328, 329, and 356, respectively, and the heavy chain variable region CDR1, CDR2, and CDR3 comprise SEQ ID NO: 428, 463, and 412, respectively. In some embodiments, the light and heavy chain variable region CDR1, CDR2, and CDR3 regions consist of SEQ ID NO: 328, 329, and 356, and SEQ ID NO: 428, 463, and 412. In one specific embodiment, the antibody comprises the same VL and VH CDRs as G9.2-22.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 357, respectively, and the heavy chain variable region CDR1, CDR2, and CDR3 comprise SEQ ID NO: 428, 464, and 413, respectively. In some embodiments, the light and heavy chain variable region CDR1, CDR2, and CDR3 regions consist of SEQ ID NO: 328, 329, and 357, and SEQ ID NO: 428, 464, and 413. In one specific embodiment, the antibody comprises the same VL and VH CDRs as G9.2-23.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 358, respectively, and the heavy chain variable region CDR1, CDR2, and CDR3 comprise SEQ ID NO: 428, 465, and 414, respectively. In some embodiments, the light and heavy chain variable region CDR1, CDR2, and CDR3 regions consist of SEQ ID NO: 328, 329, and 358, and SEQ ID NO: 428, 465, and 414. In one specific embodiment, the antibody comprises the same VL and VH CDRs as G9.2-24.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 359, respectively, and the heavy chain variable region CDR1, CDR2, and CDR3 comprise SEQ ID NO: 427, 466, and 415, respectively. In some embodiments, the light and heavy chain variable region CDR1, CDR2, and CDR3 regions consist of SEQ ID NO: 328, 329, and 359, and SEQ ID NO: 427, 466, and 415. In one specific embodiment, the antibody comprises the same VL and VH CDRs as G9.2-25.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 360, respectively, and the heavy chain variable region CDR1, CDR2, and CDR3 comprise SEQ ID NO: 361, 389, and 416, respectively. In some embodiments, the light and heavy chain variable region CDR1, CDR2, and CDR3 regions consist of SEQ ID NO: 328, 329, and 360, and SEQ ID NO: 361, 389, and 416. In one specific embodiment, the antibody comprises the same VL and VH CDRs as G9.2-26.

In some embodiments, the anti-Galectin-9 antibody or binding portion thereof comprises heavy and light chain variable regions, wherein the light chain variable region CDR1, CDR2, and CDR3 regions comprise SEQ ID NO: 328, 329, and 352, respectively, and the heavy chain variable region CDR1, CDR2, and CDR3 comprise SEQ ID NO: 361, 388, and 417, respectively. In some embodiments, the light and heavy chain variable region CDR1, CDR2, and CDR3 regions consist of SEQ ID NO: 328, 329, and 352, and SEQ ID NO: 361, 388, and 417. In one specific embodiment, the antibody comprises the same VL and VH CDRs as G9.2-low affinity binder.

Sequence Identity

In some embodiments, the anti-Galectin-9 antibody (e.g., specific to CRD1 and/or CRD2) may comprise light chain CDRs that have at least 80% (e.g., 85%, 90%, 95%, 96%, 97%, 98%, 99% and any increment therein) sequence identity, individually or collectively, as compared with the corresponding $V_L$ CDRs of an antibody or antigen binding portion thereof selected from G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, G9.2-26, and G9.2-low affinity binder. In some embodiments, the anti-Galectin-9 antibody (e.g., specific to CRD1 and/or CRD2) may comprise heavy chain CDRs that have at least 80% (e.g., 85%, 90%, 95%, 96%, 97%, 98%, 99% and any increment therein) sequence identity, individually or collectively, as compared with the corresponding $V_H$ CDRs of an antibody or antigen binding portion thereof selected from G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, G9.2-26, and G9.2-low affinity binder.

In some embodiments, the anti-Galectin-9 antibody (e.g., specific to CRD1 and/or CRD2) may comprise light chain CDRs and heavy chain CDRs that have at least 80% (e.g., 85%, 90%, 95%, 96%, 97%, 98%, 99% and any increment therein) sequence identity, individually or collectively, as compared with the corresponding $V_L$ CDRs and $V_H$ CDRs of an antibody or antigen binding portion thereof selected from G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, G9.2-26, and G9.2-low affinity binder.

In some embodiments, the anti-Galectin-9 antibody (e.g., specific to CRD1 and/or CRD2) may comprise a VL CDR1 amino acid sequence that has at least 80% (e.g., 85%, 90%, 95%, 96%, 97%, 98%, 99% and any increment therein) sequence identity to the VL CDR1 amino acid sequence set forth in SEQ ID NO: 328. In some embodiments, the anti-Galectin-9 antibody (e.g., specific to CRD1 and/or CRD2) may comprise a VL CDR2 amino acid sequence that has at least 80% (e.g., 85%, 90%, 95%, 96%, 97%, 98%, 99% and any increment therein) sequence identity to the VL CDR2 amino acid sequence set forth in SEQ ID NO: 329. In some embodiments, the anti-Galectin-9 antibody (e.g., specific to CRD1 and/or CRD2) may comprise a VL CDR3 amino acid sequence that has at least 80% (e.g., 85%, 90%, 95%, 96%, 97%, 98%, 99% and any increment therein) sequence identity to a VL CDR3 amino acid sequence selected from SEQ ID NO: 341-360.

In some embodiments, the anti-Galectin-9 antibody (e.g., specific to CRD1 and/or CRD2) may comprise a VH CDR1 amino acid sequence that has at least 80% (e.g., 85%, 90%, 95%, 96%, 97%, 98%, 99% and any increment therein) sequence identity to the VH CDR1 amino acid sequence set forth in SEQ ID NO: 361, 424-434. In some embodiments, the anti-Galectin-9 antibody (e.g., specific to CRD1 and/or CRD2) may comprise a VH CDR2 amino acid sequence that has at least 80% (e.g., 85%, 90%, 95%, 96%, 97%, 98%, 99% and any increment therein) sequence identity to a VH CDR2 amino acid sequence selected from SEQ ID NO: 362, 363, 387-389 and 446-466. In some embodiments, the anti-Galectin-9 antibody (e.g., specific to CRD1 and/or CRD2) may comprise a VH CDR3 amino acid sequence that has at least 80% (e.g., 85%, 90%, 95%, 96%, 97%, 98%, 99% and any increment therein) sequence identity to a VH CDR3 amino acid sequence selected from SEQ ID NO: 390-417.

Accordingly, in some embodiments, anti-Galectin-9 antibodies or antigen binding portions thereof comprise (a) VL CDR1 amino acid sequence that has at least 80% (e.g., 85%, 90%, 95%, 96%, 97%, 98%, 99% and any increment therein) sequence identity to the VL CDR1 amino acid sequence set forth in SEQ ID NO: 328; (b) VL CDR2 amino acid sequence that has at least 80% (e.g., 85%, 90%, 95%, 96%, 97%, 98%, 99% and any increment therein) sequence identity to the VL CDR2 amino acid sequence set forth in SEQ ID NO: 329; (c) VL CDR3 amino acid sequence that has at least 80% (e.g., 85%, 90%, 95%, 96%, 97%, 98%, 99% and any increment therein) sequence identity to the VL CDR3 amino acid sequence selected from SEQ ID NO: 341-360; (d) VH CDR1 amino acid sequence that has at least 80% (e.g., 85%, 90%, 95%, 96%, 97%, 98%, 99% and any increment therein) sequence identity to the VH CDR1 amino acid sequence set forth in SEQ ID NO: 361, 424-434; (d) VH CDR2 amino acid sequence that has at least 80% (e.g., 85%, 90%, 95%, 96%, 97%, 98%, 99% and any increment therein) sequence identity to a VH CDR2 amino acid sequence selected from SEQ ID NO: 362, 363, 387-389 and 446-466; (e) VH CDR3 amino acid sequence that has at least 80% (e.g., 85%, 90%, 95%, 96%, 97%, 98%, 99% and any increment therein) sequence identity to a VH CDR3 amino acid sequence selected from SEQ ID NO: 390-417.

In some embodiments, the anti-Galectin-9 antibody or binding portion thereof comprises heavy and light chain variable regions, wherein the light chain variable region CDR1, CDR2, and CDR3 amino acid sequences have at least 80% (e.g., 85%, 90%, 95%, 96%, 97%, 98%, 99% and any increment therein) sequence identity to the light chain variable region CDR1, CDR2, and CDR3 amino acid sequences set forth in SEQ ID NO: 328, 329, and 352, respectively. In some embodiments, the antibody VL CDR1, CDR2, and CDR3 amino acid sequences have at least 80% (e.g., 85%, 90%, 95%, 96%, 97%, 98%, 99% and any increment therein) sequence identity to the VL CDR1, CDR2, and CDR3 amino acid sequences of G9.2-17. In some embodiments, the anti-Galectin-9 antibody or binding portion thereof comprises heavy and light chain variable regions, wherein the heavy chain variable region CDR1, CDR2, and CDR3 amino acid sequences have at least 80% (e.g., 85%, 90%, 95%, 96%, 97%, 98%, 99% and any increment therein) sequence identity to the heavy chain variable region CDR1, CDR2, and CDR3 amino acid sequences set forth in SEQ ID NO: 361, 388, and 406, respectively. In some embodiments, the antibody VH CDR1, CDR2, and CDR3 amino acid sequences have at least 80% (e.g., 85%, 90%, 95%, 96%, 97%, 98%, 99% and any increment therein) sequence identity to the VH CDR1, CDR2, and CDR3 amino acid sequences of G9.2-17. In some embodiments, the anti-Galectin-9 antibody or binding portion thereof comprises heavy and light chain variable regions, wherein the light chain variable region CDR1, CDR2, and CDR3 amino acid sequences have at least 80% (e.g., 85%, 90%, 95%, 96%, 97%, 98%, 99% and any increment therein) sequence identity to the light chain variable region CDR1, CDR2, and CDR3 amino acid sequences set forth in comprise SEQ ID NO: 328, 329, and 352, respectively, and the heavy chain variable region CDR1, CDR2, and CDR3 amino acid sequences have at least 80% (e.g., 85%, 90%, 95%, 96%, 97%, 98%, 99% and any increment therein) sequence identity to the heavy chain variable region CDR1, CDR2, and CDR3 amino acid sequences set forth in SEQ ID NO: 361, 388, and 406, respectively. In one specific embodiment, the antibody VL CDR1, CDR2, and CDR3 and VH CDR1, CDR2, and CDR3 amino acid sequences have at least 80% (e.g., 85%, 90%, 95%, 96%, 97%, 98%, 99% and any increment therein) sequence identity to the VL CDR1, CDR2, and CDR3 and VH CDR1, CDR2, and CDR3 amino acid sequences of G9.2-17.

Epitopes and Constant Regions

In some embodiments, the anti-Galectin-9 antibodies described herein bind to the same epitope as any of the exemplary antibodies described herein (e.g., antibody comprising any of SEQ ID NO: 7-87 or the CDRs thereof) or competes against the exemplary antibody from binding to the Galectin-9 antigen. An "epitope" refers to the site on a target antigen that is recognized and bound by an antibody. The site can be entirely composed of amino acid components, entirely composed of chemical modifications of amino acids of the protein (e.g., glycosyl moieties), or composed of combinations thereof. Overlapping epitopes include at least one common amino acid residue. An epitope can be linear, which is typically 6-15 amino acids in length. Alternatively, the epitope can be conformational. The epitope to which an antibody binds can be determined by routine technology, for example, the epitope mapping method (see, e.g., descriptions below). An antibody that binds the same epitope as an exemplary antibody described herein may bind to exactly the same epitope or a substantially overlapping epitope (e.g., containing less than 3 non-overlapping amino acid residue, less than 2 non-overlapping amino acid residues, or only 1 non-overlapping amino acid residue) as the exemplary antibody. Whether two antibodies compete against each other from binding to the cognate antigen can be determined by a competition assay, which is well known in the art.

In some embodiments, the anti-Galectin-9 antibody may bind to an epitope at least a segment of which is in CRD1 of a galectin-9 protein (e.g., a human galectin-9 or a mouse galectin-9). In some embodiments, the antibody may bind an epitope which is entirely within the CRD1 of the Galectin-9 protein. In some embodiments, the antibody may bind an epitope which is partially within the CRD1 of the Galectin-9 protein. In some embodiments, the epitope to which the anti-Galectin antibody binds is a linear epitope. In some embodiments, the epitope to which the anti-Galectin antibody binds is a conformational epitope.

In some embodiments, the anti-Galectin-9 antibody may bind an epitope at least a segment of which is in CRD2 of a Galectin-9 protein (e.g., a human galectin-9 or a mouse galectin-9). In some embodiments, the anti-Galectin-9 antibody may bind an epitope which is entirely within the CRD2 of the Galectin-9 protein. In some specific embodiments in which the anti-Galectin-9 antibody binds an epitope partially or entirely within CDR2, the antibody binds an epitope comprising at least residue W309. In some specific embodiments, in which the anti-Galectin-9 antibody binds an epitope partially or entirely within CDR2, the epitope to which the anti-Galectin-9 antibody binds does not contain one or more of R253, R271, Y330, R334, R341, and Y236 of SEQ ID NO:1. In some embodiments, the epitope to which the anti-Galectin antibody binds is a linear epitope encompassing residue W309. In some embodiments, the epitope to which the anti-Galectin antibody binds is a conformational epitope comprising W309.

In some examples, the anti-Galectin-9 antibody comprises the same V<sub>H</sub> and/or V<sub>L</sub> CDRs as an exemplary antibody described herein. Two antibodies having the same V<sub>H</sub> and/or V<sub>L</sub> CDRs means that their CDRs are identical when determined by the same approach (e.g., the Kabat approach or the Chothia approach as known in the art). Such anti-Galectin-9 antibodies may have the same V<sub>H</sub>, the same V<sub>L</sub>, or both as compared to an exemplary antibody described herein.

Two heavy chain variable regions (or two light chain variable regions) having the same CDRs means that the CDRs in the two heavy chain variable regions (or light chain variable regions) as determined by the same numbering scheme are identical. Exemplary numbering schemes for determining antibody CDRs include the "Kabat" numbering scheme (Kabat et al. (1991), 5th Ed. Public Health Service, National Institutes of Health, Bethesda, Md.), the "Chothia" numbering scheme (Al-Lazikani et al., (1997) JMB 273, 927-948), the "Contact" numbering scheme (MacCallum et al., J. Mol. Biol. 262:732-745 (1996)), the "IMGT" numbering scheme (Lefranc M P et al., Dev Comp Immunol, 2003 January; 27(1):55-77), and the "AHo" numbering scheme (Honegger A and Pluckthun A, J Mol Biol, 2001 Jun. 8; 309(3):657-70). As known to those skilled in the art, the CDR regions of the exemplary anti-pKal and anti-FXII antibodies identified herein are determined by the "Chothia" numbering scheme, which is used as an example.

Also within the scope of the present disclosure are functional variants of any of the exemplary anti-Galectin-9 antibodies as disclosed herein. Such functional variants are substantially similar to the exemplary antibody, both structurally and functionally. A functional variant comprises substantially the same V<sub>H</sub> and V<sub>L</sub> CDRs as the exemplary antibody. For example, it may comprise only up to 5 (e.g., 4, 3, 2, or 1) amino acid residue variations in the total CDR regions of the antibody and binds the same epitope of Galectin-9 with substantially similar affinity (e.g., having a K<sub>D</sub> value in the same order). Alternatively or in addition, the amino acid residue variations are conservative amino acid residue substitutions. As used herein, a "conservative amino acid substitution" refers to an amino acid substitution that does not alter the relative charge or size characteristics of the protein in which the amino acid substitution is made. Variants can be prepared according to methods for altering polypeptide sequence known to one of ordinary skill in the art such as are found in references which compile such methods, e.g. Molecular Cloning: A Laboratory Manual, J. Sambrook, et al., eds., Second Edition, Cold Spring Harbor Laboratory Press, Cold Spring Harbor, N.Y., 1989, or Current Protocols in Molecular Biology, F. M. Ausubel, et al., eds., John Wiley & Sons, Inc., New York. Conservative substitutions of amino acids include substitutions made amongst amino acids within the following groups: (a) M, I, L, V; (b) F, Y, W; (c) K, R, H; (d) A, G; (e) S, T; (f) Q, N; and (g) E, D.

The "percent identity" of two amino acid sequences is determined using the algorithm of Karlin and Altschul Proc. Natl. Acad. Sci. USA 87:2264-68, 1990, modified as in Karlin and Altschul Proc. Natl. Acad. Sci. USA 90:5873-77, 1993. Such an algorithm is incorporated into the NBLAST and XBLAST programs (version 2.0) of Altschul, et al. J. Mol. Biol. 215:403-10, 1990. BLAST protein searches can be performed with the XBLAST program, score=50, word-length=3 to obtain amino acid sequences homologous to the protein molecules of interest. Where gaps exist between two sequences, Gapped BLAST can be utilized as described in Altschul et al., *Nucleic Acids Res.* 25(17):3389-3402, 1997. When utilizing BLAST and Gapped BLAST programs, the default parameters of the respective programs (e.g., XBLAST and NBLAST) can be used. The anti-Galectin-9 antibody may comprise a heavy chain variable region framework derived from a subclass of germline V<sub>H</sub> fragment. Such germline V<sub>H</sub> regions are well known in the art. See, e.g., the IMGT database (www.imgt.org) or at www.vbase2.org/vbstat.php. Examples include the IGHV1 subfamily (e.g., IGHV1-2, IGHV1-3, IGHV1-8, IGHV1-18, IGHV1-24, IGHV1-45, IGHV1-46, IGHV1-58, and IGHV1-69), the IGHV2 subfamily (e.g., IGHV2-5, IGHV2-26, and IGHV2-70), the IGHV3 subfamily (e.g., IGHV3-7, IGHV3-9, IGHV3-11, IGHV3-13, IGHV3-15, IGHV3-20, IGHV3-21, IGHV3-23, IGHV3-30, IGHV3-33, IGHV3-43, IGHV3-48, IGHV3-49, IGHV3-53, IGHV3-64, IGHV3-66, IGHV3-72, and IGHV3-73, IGHV3-74), the IGHV4 subfamily (e.g., IGHV4-4, IGHV4-28, IGHV4-31, IGHV4-34, IGHV4-39, IGHV4-59, IGHV4-61, and IGHV4-B), the IGHV subfamily (e.g., IGHV5-51, or IGHV6-1), and the IGHV7 subfamily (e.g., IGHV7-4-1).

Alternatively or in addition, the anti-Galectin-9 antibody may comprise a light chain variable region that contains a framework derived from a germline Vκ fragment. Examples include an IGKV1 framework (e.g., IGKV1-05, IGKV1-12, IGKV1-27, IGKV1-33, or IGKV1-39), an IGKV2 framework (e.g., IGKV2-28), an IGKV3 framework (e.g., IGKV3-11, IGKV3-15, or IGKV3-20), and an IGKV4 framework (e.g., IGKV4-1). In other instances, the anti-Galectin-9 antibody may comprise a light chain variable region that contains a framework derived from a germline Vλ, fragment. Examples include an IGλ1 framework (e.g., IGλV1-36, IGλV1-40, IGλV1-44, IGλV1-47, IGλV1-51), an IGλ2 framework (e.g., IGλ, V2-8, IGλV2-11, IGλV2-14, IGλV2-18, IGλV2-23,), an IGλ3 framework (e.g., IGλ, V3-1, IGλV3-10, IGλV3-12, IGλV3-16, IGλV3-19, IGλV3-21, IGλV3-25, IGλV3-27,), an IGλ4 framework (e.g., IGλV4-60, IGλV4-69,), an IGλ5 framework (e.g., IGλV5-39, IGλV5-45,), an IGλ6 framework (e.g., IGλV6-57,), an IGλ7 framework (e.g., IGλV7-43, IGλV7-46,), an IGλ8 framework (e.g., IGλV8-61), an IGλ9 framework (e.g., IGλV9-49), or an IGλ10 framework (e.g., IGλ, V10-54).

In some embodiments, the heavy chain of any of the anti-Galectin-9 antibodies as described herein may further comprise a heavy chain constant region (CH) or a portion thereof (e.g., CH1, CH2, CH3, or a combination thereof). The heavy chain constant region can be of any suitable origin, e.g., human, mouse, rat, or rabbit. In one specific example, the heavy chain constant region is from a human IgG (a gamma heavy chain) of any IgG subfamily as described herein.

In some embodiments, the heavy chain constant region of the antibodies described herein may comprise a single domain (e.g., CH1, CH2, or CH3) or a combination of any of the single domains, of a constant region (e.g., SEQ ID NO: 419-423). In some embodiments, the light chain constant region of the antibodies described herein may comprise a single domain (e.g., CL), of a constant region (e.g., SEQ ID NO: 418). Exemplary light and heavy chain sequences are listed below. The hIgG1 LALA sequence includes two mutations, L234A and L235A, which suppress FcgR binding as well as a P329G mutation to abolish complement C1q binding, thus abolishing all immune effector functions. These mutations are underlined and bolded in the sequences listed below. The hIgG4 Fab Arm Exchange Mutant sequence includes a mutation to suppress Fab Arm Exchange (S228P), underlined and bolded. The light chain sequence for G9.2-17 is identical among all G9.-2-17 constructs. Similarly, the light chain sequence for G9.1-8m13 is identical among all G9.1-8m13 constructs. Bolded residues are the VH and VL regions. A IL2 signal sequence (MYRMQLLSCIALSLALVTNS; SEQ ID NO: 29) is located N-terminally of the variable region. It is used in expression vectors, which is cleaved during secretion and thus not in the mature antibody molecule. The mature protein (after secretion) starts with "EVQ" for the heavy chain and "DIM" for the light chain.

Exemplary Heavy and Light Chain Sequences

G9.2-17 hIgG1 Heavy Chain
(SEQ ID NO: 157)
EVQLVESGGGLVQPGGSLRLSCAASGFIVSSSSIHWVRQAPGKGLEWVAYISSSSGYTYYADSVKGRFTI
SADTSKNTAYLQMNSLRAEDTAVYYCARYWSYPSWWPYRGMDYWGQGTLVTVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAKGQP
REPQVYTLPPSREEMTKNQVSLTCLVKGFYPSDIAVEWESNGQPENNYKTTPPVLDSDGSFFLYSKLTVD
KSRWQQGNVFSCSVMHEALHNHYTQKSLSLSPGK*

_Light Chain
(SEQ ID NO: 108)
DIQMTQSPSSLSASVGDRVTITCRASQSVSSAVAWYQQKPGKAPKLLIYSASSLYSGVPSRFSGSRSGTD
FTLTISSLQPEDFATYYCQQSSTDPITEGQGTKVEIKRTVAAPSVFIFPPSDEQLKSGTASVVCLLNNFY
PREAKVQWKVDNALQSGNSQESVTEQDSKDSTYSLSSTLTLSKADYEKHKVYACEVTHQGLSSPVTKSFN
RGEC*

G9.2-17 hIgG1 LALA Heavy Chain
(SEQ ID NO: 210)
EVQLVESGGGLVQPGGSLRLSCAASGFTVSSSSIHWVRQAPGKGLEWVAYISSSSGYTYYADSVKGRFTI
SADTSKNTAYLQMNSLRAEDTAVYYCARYWSYPSWWPYRGMDYWGQGTLVTVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPEAAGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALGAPIEKTISKAKGQP
REPQVYTLPPSREEMTKNQVSLTCLVKGFYPSDIAVEWESNGQPENNYKTTPPVLDSDGSFFLYSKLTVD
KSRWQQGNVFSCSVMHEALHNHYTQKSLSLSPGK*

Light Chain
(SEQ ID NO: 108)
DIQMTQSPSSLSASVGDRVTITCRASQSVSSAVAWYQQKPGKAPKLLIYSASSLYSGVPSRFSGSRSGTD
FTLTISSLQPEDFATYYCQQSSTDPITEGQGTKVEIKRTVAAPSVFIFPPSDEQLKSGTASVVCLLNNFY
PREAKVQWKVDNALQSGNSQESVTEQDSKDSTYSLSSTLTLSKADYEKHKVYACEVTHQGLSSPVTKSFN
RGEC*

G9.2-17 hIgG4 Heavy Chain
(SEQ ID NO: 263)
EVQLVESGGGLVQPGGSLRLSCAASGFTVSSSSIHWVRQAPGKGLEWVAYISSSSGYTYYADSVKGRFTI
SADTSKNTAYLQMNSLRAEDTAVYYCARYWSYPSWWPYRGMDYWGQGTLVTVSSASTKGPSVFPLAPCSR
STSESTAALGCLVKDYFPEPVTVSWNSGALTSGVHTFPAVLQSSGLYSLSSVVTVPSSSLGTKTYTCNVD
HKPSNTKVDKRVESKYGPPCPSCPAPEFLGGPSVFLFPPKPKDTLMISRTPEVTCVVVDVSQEDPEVQFN
WYVDGVEVHNAKTKPREEQFNSTYRVVSVLTVLHQDWLNGKEYKCKVSNKGLPSSIEKTISKAKGQPREP
QVYTLPPSQEEMTKNQVSLTCLVKGFYPSDIAVEWESNGQPENNYKTTPPVLDSDGSFFLYSRLTVDKSR
WQEGNVFSCSVMHEALHNHYTQKSLSLSPGK*

Light Chain
(SEQ ID NO: 108)
DIQMTQSPSSLSASVGDRVTITCRASQSVSSAVAWYQQKPGKAPKLLIYSASSLYSGVPSRFSGSRSGTD
FTLTISSLQPEDFATYYCQQSSTDPITEGQGTKVEIKRTVAAPSVFIFPPSDEQLKSGTASVVCLLNNFY

PREAKVQWKVDNALQSGNSQESVTEQDSKDSTYSLSSTLTLSKADYEKHKVYACEVTHQGLSSPVTKSFN

RGEC*

G9.2-17 hIgG4 Fab Arm Exchange mut Heavy Chain
(SEQ ID NO: 316)

EVQLVESGGGLVQPGGSLRLSCAASGFTVSSSSIHWVRQAPGKGLEWVAYISSSSGYTYYADSVKGRFTI

SADTSKNTAYLQMNSLRAEDTAVYYCARYWSYPSWWPYRGMDYWGQGTLVTVSSASTKGPSVFPLAPCSR

STSESTAALGCLVKDYFPEPVTVSWNSGALTSGVHTFPAVLQSSGLYSLSSVVTVPSSSLGTKTYTCNVD

HKPSNTKVDKRVESKYGPPCPPCPAPEFLGGPSVFLFPPKPKDTLMISRTPEVTCVVVDVSQEDPEVQFN

WYVDGVEVHNAKTKPREEQFNSTYRVVSVLIVLHQDWLNGKEYKCKVSNKGLPSSIEKTISKAKGQPREP

QVYTLPPSQEEMTKNQVSLTCLVKGFYPSDIAVEWESNGQPENNYKTTPPVLDSDGSFFLYSRLTVDKSR

WQEGNVFSCSVMHEALHNHYTQKSLSLSPGK*

Light Chain
(SEQ ID NO: 108)

DIQMTQSPSSLSASVGDRVTITCRASQSVSSAVAWYQQKPGKAPKLLIYSASSLYSGVPSRFSGSRSGTD

FTLTISSLQPEDFATYYCQQSSTDPITEGQGTKVEIKRTVAAPSVFIFPPSDEQLKSGTASVVCLLNNFY

PREAKVQWKVDNALQSGNSQESVTEQDSKDSTYSLSSTLTLSKADYEKHKVYACEVTHQGLSSPVTKSFN

RGEC*

G9.1-8m13 hIgG1 Heavy Chain
(SEQ ID NO: 136)

EVQLVESGGGLVQPGGSLRLSCAASGFTVSSSSIHWVRQAPGKGLEWVAYTYPYSSSSSYADSVKGRFTI

SADTSKNTAYLQMNSLRAEDTAVYYCARYSTYSSKWVWGMDYWGQGTLVTVSSASTKGPSVFPLAPSSKS

TSGGTAALGCLVKDYFPEPVTVSWNSGALTSGVHTFPAVLQSSGLYSLSSVVTVPSSSLGTQTYICNVNH

KPSNTKVDKKVEPKSCDKTHTCPPCPAPELLGGPSVFLFPPKPKDTLMISRTPEVTCVVVDVSHEDPEVK

FNWYVDGVEVHNAKTKPREEQYNSTYRVVSVLIVLHQDWLNGKEYKCKVSNKALPAPIEKTISKAKGQPR

EPQVYTLPPSREEMTKNQVSLTCLVKGFYPSDIAVEWESNGQPENNYKTTPPVLDSDGSFFLYSKLTVDK

SRWQQGNVFSCSVMHEALHNHYTQKSLSLSPGK*

Light Chain
(SEQ ID NO: 108)

DIQMTQSPSSLSASVGDRVTITCRASQSVSSAVAWYQQKPGKAPKLLIYSASSLYSGVPSRFSGSRSGTD

FTLTISSLQPEDFATYYCQQSYYDSNPITEGQGTKVEIKRTVAAPSVFIFPPSDEQLKSGTASVVCLLNN

FYPREAKVQWKVDNALQSGNSQESVTEQDSKDSTYSLSSTLTLSKADYEKHKVYACEVTHQGLSSPVTKS

FNRGEC*

G9.1-8m13 hIgG1 LALA Heavy Chain
(SEQ ID NO: 189)

EVQLVESGGGLVQPGGSLRLSCAASGFTVSSSSIHWVRQAPGKGLEWVAYTYPYSSSSSYADSVKGRFTI

SADTSKNTAYLQMNSLRAEDTAVYYCARYSTYSSKWVWGMDYWGQGTLVTVSSASTKGPSVFPLAPSSKS

TSGGTAALGCLVKDYFPEPVTVSWNSGALTSGVHTFPAVLQSSGLYSLSSVVTVPSSSLGTQTYICNVNH

KPSNTKVDKKVEPKSCDKTHTCPPCPAPEAAGGPSVFLFPPKPKDTLMISRTPEVTCVVVDVSHEDPEVK

FNWYVDGVEVHNAKTKPREEQYNSTYRVVSVLIVLHQDWLNGKEYKCKVSNKALGAPIEKTISKAKGQPR

EPQVYTLPPSREEMTKNQVSLTCLVKGFYPSDIAVEWESNGQPENNYKTTPPVLDSDGSFFLYSKLTVDK

SRWQQGNVFSCSVMHEALHNHYTQKSLSLSPGK*

_Light Chain
(SEQ ID NO: 108)

DIQMTQSPSSLSASVGDRVTITCRASQSVSSAVAWYQQKPGKAPKLLIYSASSLYSGVPSRFSGSRSGTD

FTLTISSLQPEDFATYYCQQSYYDSNPITEGQGTKVEIKRTVAAPSVFIFPPSDEQLKSGTASVVCLLNN

FYPREAKVQWKVDNALQSGNSQESVTEQDSKDSTYSLSSTLTLSKADYEKHKVYACEVTHQGLSSPVTKS

FNRGEC*

G9.1-8m13 hIgG4 Heavy Chain
(SEQ ID NO: 242)
EVQLVESGGGLVQPGGSLRLSCAASGFTVSSSSIHWVRQAPGKGLEWVAYTYPYSSSSSYADSVKGRFTI

SADTSKNTAYLQMNSLRAEDTAVYYCARYSTYSSKWVWGMDYWGQGTLVTVSSASTKGPSVFPLAPCSRS

TSESTAALGCLVKDYFPEPVTVSWNSGALTSGVHTFPAVLQSSGLYSLSSVVTVPSSSLGTKTYTCNVDH

KPSNTKVDKRVESKYGPPCPSCPAPEFLGGPSVFLFPPKPKDTLMISRTPEVTCVVVDVSQEDPEVQFNW

YVDGVEVHNAKTKPREEQFNSTYRVVSVLTVLHQDWLNGKEYKCKVSNKGLPSSIEKTISKAKGQPREPQ

VYTLPPSQEEMTKNQVSLTCLVKGFYPSDIAVEWESNGQPENNYKTTPPVLDSDGSFFLYSRLTVDKSRW

QEGNVFSCSVMHEALHNHYTQKSLSLSPGK*

Light Chain
(SEQ ID NO: 108)
DIQMTQSPSSLSASVGDRVTITCRASQSVSSAVAWYQQKPGKAPKLLIYSASSLYSGVPSRFSGSRSGTD

FTLTISSLQPEDFATYYCQQSYYDSNPITEGQGTKVEIKRTVAAPSVFIFPPSDEQLKSGTASVVCLLNN

FYPREAKVQWKVDNALQSGNSQESVTEQDSKDSTYSLSSTLTLSKADYEKHKVYACEVTHQGLSSPVTKS

FNRGEC*

G9.1-8m13 hIgG4 Fab Arm Exchange mut Heavy Chain
(SEQ ID NO: 295)
EVQLVESGGGLVQPGGSLRLSCAASGFTVSSSSIHWVRQAPGKGLEWVAYTYPYSSSSSYADSVKGRFTI

SADTSKNTAYLQMNSLRAEDTAVYYCARYSTYSSKWVWGMDYWGQGTLVTVSSASTKGPSVFPLAPCSRS

TSESTAALGCLVKDYFPEPVTVSWNSGALTSGVHTFPAVLQSSGLYSLSSVVTVPSSSLGTKTYTCNVDH

KPSNTKVDKRVESKYGPPCPPCPAPEFLGGPSVFLFPPKPKDTLMISRTPEVTCVVVDVSQEDPEVQFNW

YVDGVEVHNAKTKPREEQFNSTYRVVSVLTVLHQDWLNGKEYKCKVSNKGLPSSIEKTISKAKGQPREPQ

VYTLPPSQEEMTKNQVSLTCLVKGFYPSDIAVEWESNGQPENNYKTTPPVLDSDGSFFLYSRLTVDKSRW

QEGNVFSCSVMHEALHNHYTQKSLSLSPGK*

Light Chain
(SEQ ID NO: 108)
DIQMTQSPSSLSASVGDRVTITCRASQSVSSAVAWYQQKPGKAPKLLIYSASSLYSGVPSRFSGSRSGTD

FTLTISSLQPEDFATYYCQQSYYDSNPITEGQGTKVEIKRTVAAPSVFIFPPSDEQLKSGTASVVCLLNN

FYPREAKVQWKVDNALQSGNSQESVTEQDSKDSTYSLSSTLTLSKADYEKHKVYACEVTHQGLSSPVTKS

FNRGEC

In some embodiments, the anti-Galectin 9 antibody has a light chain comprising, consisting essentially of, or consisting of SEQ ID NO: 108. In some embodiments, the anti-Galectin 9 antibody has a heavy chain comprising, consisting essentially of, or consisting of any one of the sequences selected from the group consisting of SEQ ID NO: 295, 242, 189, 157, 210, 263, 316, and 136. In some embodiments, the anti-Galectin 9 antibody has a light chain comprising, consisting essentially of, or consisting of SEQ ID NO: 108 and a heavy chain comprising, consisting essentially of, or consisting of any one of the sequences selected from the group consisting of SEQ ID NO: 295, 242, 189, 157, 210, 263, 316, and 136. In some embodiments, the anti-Galectin 9 antibody has a light chain comprising SEQ ID NO: 108 and a heavy chain comprising any one of the sequences selected from the group consisting of SEQ ID NO: 295, 242, 189, 157, 210, 263, 316, and 136. In some embodiments, the anti-Galectin 9 antibody has a light chain consisting essentially of SEQ ID NO: 108 and a heavy chain consisting essentially of any one of the sequences selected from the group consisting of SEQ ID NO: 295, 242, 189, 157, 210, 263, 316, and 136. In some embodiments, the anti-Galectin 9 antibody has a light chain consisting of SEQ ID NO: 108 and a heavy chain consisting of any one of the sequences selected from the group consisting of SEQ ID NO: 295, 242, 189, 157, 210, 263, 316, and 136.

In some embodiments, the constant region is from human IgG4. In one embodiment, the constant region of the anti-Galectin-9 antibody comprises a heavy chain IgG4 constant region that has at least 80% (e.g., 85%, 90%, 95%, 96%, 97%, 98%, 99% and any increment therein) sequence identity to SEQ ID NO: 423. In one embodiment, the constant region of the anti-Galectin-9 antibody comprises a heavy chain IgG4 constant region comprising SEQ ID NO: 423. In one embodiment, the constant region of the anti-Galectin-9 antibody comprises a heavy chain IgG4 constant region consisting of SEQ ID NO: 423. In one embodiment, the constant region of the anti-Galectin-9 antibody comprises a heavy chain IgG4 constant region that has at least 80% (e.g., 85%, 90%, 95%, 96%, 97%, 98%, 99% and any increment therein) sequence identity to SEQ ID NO: 421. In one embodiment, the constant region of the anti-Galectin-9 antibody comprises a heavy chain IgG4 constant region comprising SEQ ID NO: 421. In one embodiment, the constant region of the anti-Galectin-9 antibody comprises a heavy chain IgG4 constant region consisting of SEQ ID NO: 421.

In some embodiments, the constant region of the anti-Galectin-9 antibody comprises a light chain IgG4 constant region that has at least 80% (e.g., 85%, 90%, 95%, 96%, 97%, 98%, 99% and any increment therein) sequence identity to SEQ ID NO: 418. In one embodiment, the constant region of the anti-Galectin-9 antibody comprises a light chain IgG4 constant region comprising SEQ ID No: 418. In one embodiment, the constant region of the anti-Galectin-9 antibody comprises a light chain IgG4 constant region consisting of SEQ ID NO: 418. In some embodiments, the constant region is from a human IgG1. In some embodiments, the constant region of the anti-Galectin-9 antibody comprises a heavy chain IgG1 constant region that has at least 80% (e.g., 85%, 90%, 95%, 96%, 97%, 98%, 99% and any increment therein) sequence identity to SEQ ID NO: 419. In one embodiment, the constant region of the anti-Galectin-9 antibody comprises a heavy chain IgG1 constant region comprising SEQ ID NO: 419. In one embodiment, the constant region of the anti-Galectin-9 antibody comprises a heavy chain IgG4 constant region consisting of SEQ ID NO: 419. In one embodiment, the constant region of the anti-Galectin-9 antibody comprises a light chain IgG1 constant region comprising SEQ ID NO: 418. In one embodiment, the constant region of the anti-Galectin-9 antibody comprises a light chain IgG4 constant region consisting of SEQ ID NO: 418.

In some embodiments, the anti-Galectin-9 antibody comprises a modified constant region. In some embodiments, the anti-Galectin-9 antibody comprise a modified constant region that is immunologically inert, e.g., does not trigger complement mediated lysis, or does not stimulate antibody-dependent cell mediated cytotoxicity (ADCC). ADCC activity can be assessed using methods disclosed in U.S. Pat. No. 5,500,362. In other embodiments, the constant region is modified as described in Eur. J. Immunol. (1999) 29:2613-2624; PCT Application No. PCT/GB99/01441; and/or UK Patent Application No. 9809951.8. In some embodiments, the IgG4 constant region is a mutant with reduced heavy chain exchange. In some embodiments, the constant region is from a human IgG4 Fab Arm Exchange mutant S228P. In one embodiment, the constant region of the anti-Galectin-9 antibody comprises a heavy chain IgG4 constant region that has at least 80% (e.g., 85%, 90%, 95%, 96%, 97%, 98%, 99% and any increment therein) sequence identity to SEQ ID NO: 422. In one embodiment, the constant region of the anti-Galectin-9 antibody comprises a heavy chain IgG4 constant region comprising SEQ ID NO: 422. In one embodiment, the constant region of the anti-Galectin-9 antibody comprises a heavy chain IgG4 constant region consisting of SEQ ID NO: 422. In some embodiments, the constant region of the anti-Galectin-9 antibody comprises a light chain IgG4 constant region that has at least 80% (e.g., 85%, 90%, 95%, 96%, 97%, 98%, 99% and any increment therein) sequence identity to SEQ ID NO: 418. In one embodiment, the constant region of the anti-Galectin-9 antibody comprises a light chain IgG4 constant region comprising SEQ ID NO: 418. In one embodiment, the constant region of the anti-Galectin-9 antibody comprises a light chain IgG4 constant region consisting of SEQ ID NO: 418. In some embodiments, the IgG is a mutant with minimal Fc receptor engagement. In one example, the constant region is from a human IgG1 LALA. In one embodiment, the constant region of the anti-Galectin-9 antibody comprises a heavy chain IgG1 constant region that has at least 80% (e.g., 85%, 90%, 95%, 96%, 97%, 98%, 99% and any increment therein) sequence identity to SEQ ID NO: 420. In one embodiment, the constant region of the anti-Galectin-9 antibody comprises a heavy chain IgG1 constant region comprising SEQ ID NO: 420. In one embodiment, the constant region of the anti-Galectin-9 antibody comprises a heavy chain IgG1 constant region consisting of SEQ ID NO: 420. In one embodiment, the constant region of the anti-Galectin-9 antibody comprises a light chain IgG1 constant region that has at least 80% (e.g., 85%, 90%, 95%, 96%, 97%, 98%, 99% and any increment therein) sequence identity to SEQ ID NO: 418. In one embodiment, the constant region of the anti-Galectin-9 antibody comprises a light chain IgG1 constant region comprising SEQ ID NO: 418. In one embodiment, the constant region of the anti-Galectin-9 antibody comprises a light chain IgG4 constant region consisting of SEQ ID NO: 418.

In some embodiments, the anti-Galectin-9 antibody has chains corresponding to SEQ ID NO: 88-98 (anti-Galectin-9 antibodies binding to CRD1) and SEQ ID NO: 99-115 (anti-Galectin-9 antibodies binding to CRD2) for the light chains; The amino acid sequences of exemplary heavy chains correspond to SEQ ID NO: 116-140 (hIgG1); 169-193 (hIgG1 LALA); 222-246 (hIgG4); 275-299 (hIgG4 exchange mut) (anti-Galectin-9 antibodies binding to CRD1) and SEQ ID NO: 141-168 (hIgG1); 194-221 (hIgG1 LALA); 247-274 (hIgG4); 300-327 (hIgG4 exchange mut) (anti-Galectin-9 antibodies binding to CRD2) for the heavy chains. IgG LALA, IgG4 exchange mut are located in the heavy chains; accordingly the light chains are the same for all IgG1 and IgG4 sequences disclosed herein. In some embodiments, the amino acid sequences of exemplary anti-Galectin antibody light chains correspond to sequences set forth in SEQ ID NO: 88-98 and SEQ ID NO: 99-115.

Clone 9.1-Derived Light Chains

In some embodiments, light chains of anti-Galectin-9 antibodies comprise an amino acid sequence that has at least 80% (e.g., 85%, 90%, 95%, 96%, 97%, 98%, 99% and any increment therein) sequence identity to any of the light chains set forth herein (or their variable regions), (e.g., light chain sequences set forth in SEQ ID NO: 88-98. In some embodiments, light chains of anti-Galectin-9 antibodies consist of an amino acid sequence that has at least 80% (e.g., 85%, 90%, 95%, 96%, 97%, 98%, 99% and any increment therein) sequence identity to any of the light chains set forth herein, (e.g., light chain sequences set forth in SEQ ID NO: 88-98. In some embodiments, light chains of anti-Galectin-9 antibodies comprise an amino acid sequence set forth in SEQ ID NO: 88-98. In some embodiments, light chains of anti-Galectin-9 antibodies consist of an amino acid sequence set forth in SEQ ID NO: 88-98.

In some embodiments, the anti-Galectin-9 antibodies or antigen-binding portion thereof comprise a light chain sequence of SEQ ID NO: 88. In some embodiments, the anti-Galectin-9 antibodies or antigen-binding portion thereof comprise a light chain sequence of SEQ ID NO: 89. In some embodiments, the anti-Galectin-9 antibodies or antigen-binding portion thereof comprise a light chain sequence of SEQ ID NO: 90. In some embodiments, the anti-Galectin-9 antibodies or antigen-binding portion thereof comprise a light chain sequence of SEQ ID NO: 91. In some embodiments, the anti-Galectin-9 antibodies or antigen-binding portion thereof comprise a light chain sequence of SEQ ID NO: 92. In some embodiments, the anti-Galectin-9 antibodies or antigen-binding portion thereof comprise a light chain sequence of SEQ ID NO: 93.

In some embodiments, the anti-Galectin-9 antibodies or antigen-binding portion thereof comprise a light chain sequence of SEQ ID NO: 94. In some embodiments, the anti-Galectin-9 antibodies or antigen-binding portion thereof comprise a light chain sequence of SEQ ID NO: 95. In some embodiments, the anti-Galectin-9 antibodies or antigen-binding portion thereof comprise a light chain sequence of SEQ ID NO: 96. In some embodiments, the anti-Galectin-9 antibodies or antigen-binding portion thereof comprise a light chain sequence of SEQ ID NO: 97. In some embodiments, the anti-Galectin-9 antibodies or antigen-binding portion thereof comprise a light chain sequence of SEQ ID NO: 98.

In some embodiments, light chains of anti-Galectin-9 antibodies comprise an amino acid sequence that has at least 80% (e.g., 85%, 90%, 95%, 96%, 97%, 98%, 99% and any increment therein) sequence identity to the light chain sequence set forth in SEQ ID NO: 95 (or their variable regions). In some embodiments, light chains of anti-Galectin-9 antibodies consist of an amino acid sequence that has at least 80% (e.g., 85%, 90%, 95%, 96%, 97%, 98%, 99% and any increment therein) sequence identity to the light chain sequence set forth in SEQ ID NO: 95. In some embodiments, light chains of anti-Galectin-9 antibodies comprise an amino acid sequence set forth in SEQ ID NO: 95 (or their variable regions). In some embodiments, light chains of anti-Galectin-9 antibodies consist of the amino acid sequence set forth in SEQ ID NO: 95.

Clone 9.1-Derived Heavy Chains

In some embodiments, the amino acid sequences of exemplary anti-Galectin antibody heavy chains correspond to sequences set forth in SEQ ID NO: 116-140 (hIgG1); 169-193 (hIgG1 LALA); 222-246 (hIgG4); 275-299 (hIgG4 exchange mut) (anti-Galectin-9 antibodies binding to CRD1). In some embodiments, heavy chains of anti-Galectin-9 antibodies comprise an amino acid sequence that has at least 80% (e.g., 85%, 90%, 95%, 96%, 97%, 98%, 99% and any increment therein) sequence identity to any of the heavy chains set forth herein (or their variable regions), e.g., sequences set forth in SEQ ID NO: 116-140; 169-193; 222-246; 275-299 (anti-Galectin-9 antibodies binding to CRD1). In some embodiments, heavy chains of anti-Galectin-9 antibodies consist of an amino acid sequence that has at least 80% (e.g., 85%, 90%, 95%, 96%, 97%, 98%, 99% and any increment therein) sequence identity to any of the heavy chains set forth herein, e.g., sequences set forth in SEQ ID NO: 116-140; 169-193; 222-246; 275-299 (anti-Galectin-9 antibodies binding to CRD1).

In some embodiments, heavy chains of anti-Galectin-9 antibodies comprise an heavy chain amino acid sequence set forth in SEQ ID NO: 116-140; 169-193; 222-246; 275-299 (anti-Galectin-9 antibodies binding to CRD1). In some embodiments, heavy chains of anti-Galectin-9 antibodies consist of an amino acid sequence set forth in SEQ ID NO: 116-140; 169-193; 222-246; 275-299 (anti-Galectin-9 antibodies binding to CRD1).

In some embodiments, the constant region is IgG1. In some embodiments, the anti-Galectin-9 antibodies or antigen-binding portion thereof comprise a heavy chain sequence of SEQ ID NO: 116. In some embodiments, the anti-Galectin-9 antibodies or antigen-binding portion thereof comprise a heavy chain sequence of SEQ ID NO: 117. In some embodiments, the anti-Galectin-9 antibodies or antigen-binding portion thereof comprise a heavy chain sequence of SEQ ID NO: 118. In some embodiments, the anti-Galectin-9 antibodies or antigen-binding portion thereof comprise a heavy chain sequence of SEQ ID NO: 119. In some embodiments, the anti-Galectin-9 antibodies or antigen-binding portion thereof comprise a heavy chain sequence of SEQ ID NO: 120. In some embodiments, the anti-Galectin-9 antibodies or antigen-binding portion thereof comprise a heavy chain sequence of SEQ ID NO: 121. In some embodiments, the anti-Galectin-9 antibodies or antigen-binding portion thereof comprise a heavy chain sequence of SEQ ID NO: 122. In some embodiments, the anti-Galectin-9 antibodies or antigen-binding portion thereof comprise a heavy chain sequence of SEQ ID NO: 123. In some embodiments, the anti-Galectin-9 antibodies or antigen-binding portion thereof comprise a heavy chain sequence of SEQ ID NO: 124. In some embodiments, the anti-Galectin-9 antibodies or antigen-binding portion thereof comprise a heavy chain sequence of SEQ ID NO: 125. In some embodiments, the anti-Galectin-9 antibodies or antigen-binding portion thereof comprise a heavy chain sequence of SEQ ID NO: 126. In some embodiments, the anti-Galectin-9 antibodies or antigen-binding portion thereof comprise a heavy chain sequence of SEQ ID NO: 127. In some embodiments, the anti-Galectin-9 antibodies or antigen-binding portion thereof comprise a heavy chain sequence of SEQ ID NO: 128. In some embodiments, the anti-Galectin-9 antibodies or antigen-binding portion thereof comprise a heavy chain sequence of SEQ ID NO: 129. In some embodiments, the anti-Galectin-9 antibodies or antigen-binding portion thereof comprise a heavy chain sequence of SEQ ID NO: 130. In some embodiments, the anti-Galectin-9 antibodies or antigen-binding portion thereof comprise a heavy chain sequence of SEQ ID NO: 131. In some embodiments, the anti-Galectin-9 antibodies or antigen-binding portion thereof comprise a heavy chain sequence of SEQ ID NO: 132. In some embodiments, the anti-Galectin-9 antibodies or antigen-binding portion thereof comprise a heavy chain sequence of SEQ ID NO: 133. In some embodiments, the anti-Galectin-9 antibodies or antigen-binding portion thereof comprise a heavy chain sequence of SEQ ID NO: 134. In some embodiments, the anti-Galectin-9 antibodies or antigen-binding portion thereof comprise a heavy chain sequence of SEQ ID NO: 135. In some embodiments, the anti-Galectin-9 antibodies or antigen-binding portion thereof comprise a heavy chain sequence of SEQ ID NO: 136. In some embodiments, the anti-Galectin-9 antibodies or antigen-binding portion thereof comprise a heavy chain sequence of SEQ ID NO: 137. In some embodiments, the anti-Galectin-9 antibodies or antigen-binding portion thereof comprise a heavy chain sequence of SEQ ID NO: 138. In some embodiments, the anti-Galectin-9 antibodies or antigen-binding portion thereof comprise a heavy chain sequence of SEQ ID NO: 139. In some embodiments, the anti-Galectin-9 antibodies or antigen-binding portion thereof comprise a heavy chain sequence of SEQ ID NO: 140.

In some embodiments, the constant region is IgG1 LALA. In some embodiments, the anti-Galectin-9 antibodies or antigen-binding portion thereof comprise a heavy chain sequence of SEQ ID NO: 169. In some embodiments, the anti-Galectin-9 antibodies or antigen-binding portion thereof comprise a heavy chain sequence of SEQ ID NO: 170. In some embodiments, the anti-Galectin-9 antibodies or antigen-binding portion thereof comprise a heavy chain sequence of SEQ ID NO: 171. In some embodiments, the anti-Galectin-9 antibodies or antigen-binding portion thereof comprise a heavy chain sequence of SEQ ID NO: 172. In some embodiments, the anti-Galectin-9 antibodies or antigen-binding portion thereof comprise a heavy chain sequence of SEQ ID NO: 173. In some embodiments, the anti-Galectin-9 antibodies or antigen-binding portion thereof comprise a heavy chain sequence of SEQ ID NO: 174. In some embodiments, the anti-Galectin-9 antibodies or antigen-binding portion thereof comprise a heavy chain sequence of SEQ ID NO: 175. In some embodiments, the anti-Galectin-9 antibodies or antigen-binding portion thereof comprise a heavy chain sequence of SEQ ID NO: 176. In some embodiments, the anti-Galectin-9 antibodies or antigen-binding portion thereof comprise a heavy chain sequence of SEQ ID NO: 177. In some embodiments, the anti-Galectin-9 antibodies or antigen-binding portion thereof comprise a heavy chain sequence of SEQ ID NO: 178. In some embodiments, the anti-Galectin-9 antibodies or antigen-binding portion thereof comprise a heavy chain sequence of SEQ ID NO: 179. In some embodiments, the anti-Galectin-9 antibodies or antigen-binding portion thereof comprise a heavy chain sequence of SEQ ID NO: 180. In some embodiments, the anti-Galectin-9 antibodies or antigen-binding portion thereof comprise a heavy chain sequence of SEQ ID NO: 181. In some embodiments, the anti-Galectin-9 antibodies or antigen-binding portion thereof comprise a heavy chain sequence of SEQ ID NO: 182. In some embodiments, the anti-Galectin-9 antibodies or antigen-binding portion thereof comprise a heavy chain sequence of SEQ ID NO: 183. In some embodiments, the anti-Galectin-9 antibodies or antigen-binding portion thereof comprise a heavy chain sequence of SEQ ID NO: 184. In some embodiments, the anti-Galectin-9 antibodies or antigen-binding portion thereof comprise a heavy chain sequence of SEQ ID NO: 185. In some embodiments, the anti-Galectin-9 antibodies or antigen-binding portion thereof comprise a heavy chain sequence of SEQ ID NO: 186. In some embodiments, the anti-Galectin-9 antibodies or antigen-binding portion thereof comprise a heavy chain sequence of SEQ ID NO: 187. In some embodiments, the anti-Galectin-9 antibodies or antigen-binding portion thereof comprise a heavy chain sequence of SEQ ID NO: 188. In some embodiments, the anti-Galectin-9 antibodies or antigen-binding portion thereof comprise a heavy chain sequence of SEQ ID NO: 189. In some embodiments, the anti-Galectin-9 antibodies or antigen-binding portion thereof comprise a heavy chain sequence of SEQ ID NO: 190. In some embodiments, the anti-Galectin-9 antibodies or antigen-binding portion thereof comprise a heavy chain sequence of SEQ ID NO: 191. In some embodiments, the anti-Galectin-9 antibodies or antigen-binding portion thereof comprise a heavy chain sequence of SEQ ID NO: 192. In some embodiments, the anti-Galectin-9 antibodies or antigen-binding portion thereof comprise a heavy chain sequence of SEQ ID NO: 193.

In some embodiments, the constant region is IgG4. In some embodiments, the anti-Galectin-9 antibodies or antigen-binding portion thereof comprise a heavy chain sequence of SEQ ID NO: 222. In some embodiments, the anti-Galectin-9 antibodies or antigen-binding portion thereof comprise a heavy chain sequence of SEQ ID NO: 223. In some embodiments, the anti-Galectin-9 antibodies or antigen-binding portion thereof comprise a heavy chain sequence of SEQ ID NO: 224. In some embodiments, the anti-Galectin-9 antibodies or antigen-binding portion thereof comprise a heavy chain sequence of SEQ ID NO: 225. In some embodiments, the anti-Galectin-9 antibodies or antigen-binding portion thereof comprise a heavy chain sequence of SEQ ID NO: 226. In some embodiments, the anti-Galectin-9 antibodies or antigen-binding portion thereof comprise a heavy chain sequence of SEQ ID NO: 227. In some embodiments, the anti-Galectin-9 antibodies or antigen-binding portion thereof comprise a heavy chain sequence of SEQ ID NO: 228. In some embodiments, the anti-Galectin-9 antibodies or antigen-binding portion thereof comprise a heavy chain sequence of SEQ ID NO: 229. In some embodiments, the anti-Galectin-9 antibodies or antigen-binding portion thereof comprise a heavy chain sequence of SEQ ID NO: 230. In some embodiments, the anti-Galectin-9 antibodies or antigen-binding portion thereof comprise a heavy chain sequence of SEQ ID NO: 231. In some embodiments, the anti-Galectin-9 antibodies or antigen-binding portion thereof comprise a heavy chain sequence of SEQ ID NO: 232. In some embodiments, the anti-Galectin-9 antibodies or antigen-binding portion thereof comprise a heavy chain sequence of SEQ ID NO: 233. In some embodiments, the anti-Galectin-9 antibodies or antigen-binding portion thereof comprise a heavy chain sequence of SEQ ID NO: 234. In some embodiments, the anti-Galectin-9 antibodies or antigen-binding portion thereof comprise a heavy chain sequence of SEQ ID NO: 235. In some embodiments, the anti-Galectin-9 antibodies or antigen-binding portion thereof comprise a heavy chain sequence of SEQ ID NO: 236. In some embodiments, the anti-Galectin-9 antibodies or antigen-binding portion thereof comprise a heavy chain sequence of SEQ ID NO: 237. In some embodiments, the anti-Galectin-9 antibodies or antigen-binding portion thereof comprise a heavy chain sequence of SEQ ID NO: 238. In some embodiments, the anti-Galectin-9 antibodies or antigen-binding portion thereof comprise a heavy chain sequence of SEQ ID NO: 29. In some embodiments, the anti-Galectin-9 antibodies or antigen-binding portion thereof comprise a heavy chain sequence of SEQ ID NO: 240. In some embodiments, the anti-Galectin-9 antibodies or antigen-binding portion thereof comprise a heavy chain sequence of SEQ ID NO: 241. In some embodiments, the anti-Galectin-9 antibodies or antigen-binding portion thereof comprise a heavy chain sequence of SEQ ID NO: 242. In some embodiments, the anti-Galectin-9 antibodies or antigen-binding portion thereof comprise a heavy chain sequence of SEQ ID NO: 243. In some embodiments, the anti-Galectin-9 antibodies or antigen-binding portion thereof comprise a heavy chain sequence of SEQ ID NO: 244. In some embodiments, the anti-Galectin-9 antibodies or antigen-binding portion thereof comprise a heavy chain sequence of SEQ ID NO: 245. In some embodiments, the anti-Galectin-9 antibodies or antigen-binding portion thereof comprise a heavy chain sequence of SEQ ID NO: 246.

In some embodiments, the constant region is IgG4mut. In some embodiments, the anti-Galectin-9 antibodies or antigen-binding portion thereof comprise a heavy chain sequence of SEQ ID NO: 275. In some embodiments, the anti-Galectin-9 antibodies or antigen-binding portion thereof comprise a heavy chain sequence of SEQ ID NO: 276. In some embodiments, the anti-Galectin-9 antibodies or antigen-binding portion thereof comprise a heavy chain sequence of SEQ ID NO: 277. In some embodiments, the anti-Galectin-9 antibodies or antigen-binding portion thereof comprise a heavy chain sequence of SEQ ID NO: 278. In some embodiments, the anti-Galectin-9 antibodies or antigen-binding portion thereof comprise a heavy chain sequence of SEQ ID NO: 279. In some embodiments, the anti-Galectin-9 antibodies or antigen-binding portion thereof comprise a heavy chain sequence of SEQ ID NO: 280. In some embodiments, the anti-Galectin-9 antibodies or antigen-binding portion thereof comprise a heavy chain sequence of SEQ ID NO: 281. In some embodiments, the anti-Galectin-9 antibodies or antigen-binding portion thereof comprise a heavy chain sequence of SEQ ID NO: 282. In some embodiments, the anti-Galectin-9 antibodies or antigen-binding portion thereof comprise a heavy chain sequence of SEQ ID NO: 283. In some embodiments, the anti-Galectin-9 antibodies or antigen-binding portion thereof comprise a heavy chain sequence of SEQ ID NO: 284. In some embodiments, the anti-Galectin-9 antibodies or antigen-binding portion thereof comprise a heavy chain sequence of SEQ ID NO: 285. In some embodiments, the anti-Galectin-9 antibodies or antigen-binding portion thereof comprise a heavy chain sequence of SEQ ID NO: 286. In some embodiments, the anti-Galectin-9 antibodies or antigen-binding portion thereof comprise a heavy chain sequence of SEQ ID NO: 287. In some embodiments, the anti-Galectin-9 antibodies or antigen-binding portion thereof comprise a heavy chain sequence of SEQ ID NO: 288. In some embodiments, the anti-Galectin-9 antibodies or antigen-binding portion thereof comprise a heavy chain sequence of SEQ ID NO: 289. In some embodiments, the anti-Galectin-9 antibodies or antigen-binding portion thereof comprise a heavy chain sequence of SEQ ID NO: 290. In some embodiments, the anti-Galectin-9 antibodies or antigen-binding portion thereof comprise a heavy chain sequence of SEQ ID NO: 291. In some embodiments, the anti-Galectin-9 antibodies or antigen-binding portion thereof comprise a heavy chain sequence of SEQ ID NO: 292. In some embodiments, the anti-Galectin-9 antibodies or antigen-binding portion thereof comprise a heavy chain sequence of SEQ ID NO: 293 In some embodiments, the anti-Galectin-9 antibodies or antigen-binding portion thereof comprise a heavy chain sequence of SEQ ID NO: 294. In some embodiments, the anti-Galectin-9 antibodies or antigen-binding portion thereof comprise a heavy chain sequence of SEQ ID NO: 295. In some embodiments, the anti-Galectin-9 antibodies or antigen-binding portion thereof comprise a heavy chain sequence of SEQ ID NO: 296. In some embodiments, the anti-Galectin-9 antibodies or antigen-binding portion thereof comprise a heavy chain sequence of SEQ ID NO: 297. In some embodiments, the anti-Galectin-9 antibodies or antigen-binding portion thereof comprise a heavy chain sequence of SEQ ID NO: 298. In some embodiments, the anti-Galectin-9 antibodies or antigen-binding portion thereof comprise a heavy chain sequence of SEQ ID NO: 299.

In some embodiments, heavy chains of anti-Galectin-9 antibodies comprise an amino acid sequence that has at least 80% (e.g., 85%, 90%, 95%, 96%, 97%, 98%, 99% and any increment therein) sequence identity to the heavy chain sequence set forth in SEQ ID NO: 136 (or its variable region). In some embodiments, heavy chains of anti-Galectin-9 antibodies consist of an amino acid sequence that has at least 80% (e.g., 85%, 90%, 95%, 96%, 97%, 98%, 99% and any increment therein) sequence identity to the heavy chain sequence set forth in SEQ ID NO: 136. In some embodiments, heavy chains of anti-Galectin-9 antibodies comprise an amino acid sequence set forth in SEQ ID NO: 136 (or its variable region). In some embodiments, heavy chains of anti-Galectin-9 antibodies consist of an amino acid sequence set forth in SEQ ID NO: 136.

In some embodiments, heavy chains of anti-Galectin-9 antibodies comprise an amino acid sequence that has at least 80% (e.g., 85%, 90%, 95%, 96%, 97%, 98%, 99% and any increment therein) sequence identity to the heavy chain sequence set forth in SEQ ID NO: 189 (or its variable region). In some embodiments, heavy chains of anti-Galectin-9 antibodies consist of an amino acid sequence that has at least 80% (e.g., 85%, 90%, 95%, 96%, 97%, 98%, 99% and any increment therein) sequence identity to the heavy chain sequence set forth in SEQ ID NO: 189. In some embodiments, heavy chains of anti-Galectin-9 antibodies comprise an amino acid sequence set forth in SEQ ID NO: 189 (or its variable region). In some embodiments, heavy chains of anti-Galectin-9 antibodies consist of an amino acid sequence set forth in SEQ ID NO: 189.

In some embodiments, heavy chains of anti-Galectin-9 antibodies comprise an amino acid sequence that has at least 80% (e.g., 85%, 90%, 95%, 96%, 97%, 98%, 99% and any increment therein) sequence identity to the heavy chain sequence set forth in SEQ ID NO: 242 (or its variable region). In some embodiments, heavy chains of anti-Galectin-9 antibodies consist of an amino acid sequence that has at least 80% (e.g., 85%, 90%, 95%, 96%, 97%, 98%, 99% and any increment therein) sequence identity to the heavy chain sequence set forth in SEQ ID NO: 242. In some embodiments, heavy chains of anti-Galectin-9 antibodies comprise an amino acid sequence set forth in SEQ ID NO: 242 (or its variable region). In some embodiments, heavy chains of anti-Galectin-9 antibodies consist of an amino acid sequence set forth in SEQ ID NO: 242.

In some embodiments, heavy chains of anti-Galectin-9 antibodies comprise an amino acid sequence that has at least 80% (e.g., 85%, 90%, 95%, 96%, 97%, 98%, 99% and any increment therein) sequence identity to the heavy chain sequence set forth in SEQ ID NO: 295 (or its variable region). In some embodiments, heavy chains of anti-Galectin-9 antibodies consist of an amino acid sequence that has at least 80% (e.g., 85%, 90%, 95%, 96%, 97%, 98%, 99% and any increment therein) sequence identity to the heavy chain sequence set forth in SEQ ID NO: 295. In some embodiments, heavy chains of anti-Galectin-9 antibodies comprise an amino acid sequence set forth in SEQ ID NO: 295. In some embodiments, heavy chains of anti-Galectin-9 antibodies consist of an amino acid sequence set forth in SEQ ID NO: 295.

Clone 9.1 Derived Heavy and Light Chains

A VH domain can comprise the amino acid sequence of any VH domain described herein fused to a human IgG, e.g., an IgG1, constant region, such as human IgG1 constant domain amino acid sequence, hIgG LALA, hIgG4, or IgG4mut.

In some embodiments, the amino acid sequences of exemplary anti-Galectin antibody light chains correspond to SEQ ID NO: 88-98, or the amino acid sequences of the exemplary anti-Galectin antibody heavy chains correspond to SEQ ID NO: 116-140; 169-193; 222-246; 275-299.

In some embodiments, the anti-Galectin-9 antibodies or antigen-binding portion thereof comprise a light chain having the sequence of SEQ ID NO: 88 and a heavy chain having a sequence selected from of SEQ ID NO: 116, 169, 222, or 275.

In some embodiments, the anti-Galectin-9 antibodies or antigen-binding portion thereof comprise a light chain having the sequence of SEQ ID NO: 89 and a heavy chain having a sequence selected from of SEQ ID NO: 117, 170, 223, or 276.

In some embodiments, the anti-Galectin-9 antibodies or antigen-binding portion thereof comprise a light chain having the sequence of SEQ ID NO: 90 and a heavy chain having a sequence selected from of SEQ ID NO: 118, 171, 224, or 277.

In some embodiments, the anti-Galectin-9 antibodies or antigen-binding portion thereof comprise a light chain having the sequence of SEQ ID NO: 91 and a heavy chain having a sequence selected from of SEQ ID NO: 119, 172, 225, or 278.

In some embodiments, the anti-Galectin-9 antibodies or antigen-binding portion thereof comprise a light chain having the sequence of SEQ ID NO: 92 and a heavy chain having a sequence selected from of SEQ ID NO: 120, 173, 226, or 279.

In some embodiments, the anti-Galectin-9 antibodies or antigen-binding portion thereof comprise a light chain having the sequence of SEQ ID NO: 93 and a heavy chain having a sequence selected from of SEQ ID NO: 121, 174, 227, or 280.

In some embodiments, the anti-Galectin-9 antibodies or antigen-binding portion thereof comprise a light chain having the sequence of SEQ ID NO: 94 and a heavy chain having a sequence selected from of SEQ ID NO: 122, 175, 228, or 281.

In some embodiments, the anti-Galectin-9 antibodies or antigen-binding portion thereof comprise a light chain having the sequence of SEQ ID NO: 95 and a heavy chain having a sequence selected from of SEQ ID NO: 123, 176, 229, or 282.

In some embodiments, the anti-Galectin-9 antibodies or antigen-binding portion thereof comprise a light chain having the sequence of SEQ ID NO: 96 and a heavy chain having a sequence selected from of SEQ ID NO: 138, 191, 244, or 297.

In some embodiments, the anti-Galectin-9 antibodies or antigen-binding portion thereof comprise a light chain having the sequence of SEQ ID NO: 97 and a heavy chain having a sequence selected from of SEQ ID NO: 139, 192, 245, or 298.

In some embodiments, the anti-Galectin-9 antibodies or antigen-binding portion thereof comprise a light chain having the sequence of SEQ ID NO: 98 and a heavy chain having a sequence selected from of SEQ ID NO: 140, 193, 246, or 299.

In some embodiments, the anti-Galectin-9 antibodies or antigen-binding portion thereof comprise a light chain having the sequence of SEQ ID NO: 95 and a heavy chain having a sequence selected from of SEQ ID NO: 124, 177, 230, or 283.

In some embodiments, the anti-Galectin-9 antibodies or antigen-binding portion thereof comprise a light chain having the sequence of SEQ ID NO: 95 and a heavy chain having a sequence selected from of SEQ ID NO: 125, 178, 231, or 284.

In some embodiments, the anti-Galectin-9 antibodies or antigen-binding portion thereof comprise a light chain having the sequence of SEQ ID NO: 95 and a heavy chain having a sequence selected from of SEQ ID NO: 126, 179, 232, or 285.

In some embodiments, the anti-Galectin-9 antibodies or antigen-binding portion thereof comprise a light chain having the sequence of SEQ ID NO: 95 and a heavy chain having a sequence selected from of SEQ ID NO: 127, 180, 233, or 286, In some embodiments, the anti-Galectin-9 antibodies or antigen-binding portion thereof comprise a light chain having the sequence of SEQ ID NO: 95 and a heavy chain having a sequence selected from of SEQ ID NO: 128, 181, 234, or 287.

In some embodiments, the anti-Galectin-9 antibodies or antigen-binding portion thereof comprise a light chain having the sequence of SEQ ID NO: 95 and a heavy chain having a sequence selected from of SEQ ID NO: 129, 182, 235, or 288.

In some embodiments, the anti-Galectin-9 antibodies or antigen-binding portion thereof comprise a light chain having the sequence of SEQ ID NO: 95 and a heavy chain having a sequence selected from of SEQ ID NO: 130, 183, 236, or 289.

In some embodiments, the anti-Galectin-9 antibodies or antigen-binding portion thereof comprise a light chain having the sequence of SEQ ID NO: 95 and a heavy chain having a sequence selected from of SEQ ID NO: 131, 184, 237, or 290.

In some embodiments, the anti-Galectin-9 antibodies or antigen-binding portion thereof comprise a light chain having the sequence of SEQ ID NO: 95 and a heavy chain having a sequence selected from of SEQ ID NO: 132, 185, 238, or 291.

In some embodiments, the anti-Galectin-9 antibodies or antigen-binding portion thereof comprise a light chain having the sequence of SEQ ID NO: 95 and a heavy chain having a sequence selected from of SEQ ID NO: 133, 186, 239, or 292.

In some embodiments, the anti-Galectin-9 antibodies or antigen-binding portion thereof comprise a light chain having the sequence of SEQ ID NO: 95 and a heavy chain having a sequence selected from of SEQ ID NO: 137, 187, 240, or 293.

In some embodiments, the anti-Galectin-9 antibodies or antigen-binding portion thereof comprise a light chain having the sequence of SEQ ID NO: 95 and a heavy chain having a sequence selected from of SEQ ID NO: 138, 188, 241, or 294.

In some embodiments, the anti-Galectin-9 antibodies or antigen-binding portion thereof comprise a light chain having the sequence of SEQ ID NO: 95 and a heavy chain having a sequence selected from of SEQ ID NO: 139, 189, 242, or 295.

In some embodiments, the anti-Galectin-9 antibodies or antigen-binding portion thereof comprise a light chain having the sequence of SEQ ID NO: 95 and a heavy chain having a sequence selected from of SEQ ID NO: 140, 190, 243, or 296.

In some embodiments, the anti-Galectin-9 antibodies or antigen-binding portion thereof comprise a light chain sequence of SEQ ID NO: 95 and comprise a heavy chain sequence of SEQ ID NO: 136. In some embodiments, light chains of anti-Galectin-9 antibodies comprise an amino acid sequence that has at least 80% (e.g., 85%, 90%, 95%, 96%, 97%, 98%, 99% and any increment therein) sequence identity to the light chain sequence set forth in SEQ ID NO: 95 (or their variable regions), and heavy chains of anti-Galectin-9 antibodies comprise an amino acid sequence that has at least 80% (e.g., 85%, 90%, 95%, 96%, 97%, 98%, 99% and any increment therein) sequence identity to the heavy chain sequence set forth in SEQ ID NO: 136 (or its variable region). In some embodiments, light chains of anti-Galectin-9 antibodies consist of an amino acid sequence that has at least 80% (e.g., 85%, 90%, 95%, 96%, 97%, 98%, 99% and any increment therein) sequence identity to the light chain sequence set forth in SEQ ID NO: 95 and heavy chains of anti-Galectin-9 antibodies consist of an amino acid sequence that has at least 80% (e.g., 85%, 90%, 95%, 96%, 97%, 98%, 99% and any increment therein) sequence identity to the heavy chain sequence set forth in SEQ ID NO: 136. In some embodiments, light chains of anti-Galectin-9 antibodies comprise an amino acid sequence set forth in SEQ ID NO: 95 (or their variable regions) heavy chains of anti-Galectin-9 antibodies comprise an amino acid sequence set forth in SEQ ID NO: 136 (or its variable region). In some embodiments, light chains of anti-Galectin-9 antibodies consist of the amino acid sequence set forth in SEQ ID NO: 95 and heavy chains of anti-Galectin-9 antibodies consist of an amino acid sequence set forth in SEQ ID NO: 136.

In some embodiments, the anti-Galectin-9 antibodies or antigen-binding portion thereof comprise a light chain sequence of SEQ ID NO: 95 and comprise a heavy chain sequence of SEQ ID NO: 189. In some embodiments, light chains of anti-Galectin-9 antibodies comprise an amino acid sequence that has at least 80% (e.g., 85%, 90%, 95%, 96%, 97%, 98%, 99% and any increment therein) sequence identity to the light chain sequence set forth in SEQ ID NO: 95 (or their variable regions) and heavy chains of anti-Galectin-9 antibodies comprise an amino acid sequence that has at least 80% (e.g., 85%, 90%, 95%, 96%, 97%, 98%, 99% and any increment therein) sequence identity to the heavy chain sequence set forth in SEQ ID NO: 189 (or its variable region) and heavy chains of anti-Galectin-9 antibodies consist of an amino acid sequence that has at least 80% (e.g., 85%, 90%, 95%, 96%, 97%, 98%, 99% and any increment therein) sequence identity to the heavy chain sequence set forth in SEQ ID NO: 189. In some embodiments, light chains of anti-Galectin-9 antibodies consist of an amino acid sequence that has at least 80% (e.g., 85%, 90%, 95%, 96%, 97%, 98%, 99% and any increment therein) sequence identity to the light chain sequence set forth in SEQ ID NO: 95. In some embodiments, light chains of anti-Galectin-9 antibodies comprise an amino acid sequence set forth in SEQ ID NO: 95 (or their variable regions) and heavy chains of anti-Galectin-9 antibodies comprise an amino acid sequence set forth in SEQ ID NO: 189 (or its variable region). In some embodiments, light chains of anti-Galectin-9 antibodies consist of the amino acid sequence set forth in SEQ ID NO: 95 and heavy chains of anti-Galectin-9 antibodies comprise an amino acid sequence set forth in SEQ ID NO: 189.

In some embodiments, the anti-Galectin-9 antibodies or antigen-binding portion thereof comprise a light chain sequence of SEQ ID NO: 95 and comprise a heavy chain sequence of SEQ ID NO: 242. In some embodiments, light chains of anti-Galectin-9 antibodies comprise an amino acid sequence that has at least 80% (e.g., 85%, 90%, 95%, 96%, 97%, 98%, 99% and any increment therein) sequence identity to the light chain sequence set forth in SEQ ID NO: 95 (or their variable regions) and heavy chains of anti-Galectin-9 antibodies comprise an amino acid sequence that has at least 80% (e.g., 85%, 90%, 95%, 96%, 97%, 98%, 99% and any increment therein) sequence identity to the heavy chain sequence set forth in SEQ ID NO: 242 (or its variable region). In some embodiments, light chains of anti-Galectin-9 antibodies consist of an amino acid sequence that has at least 80% (e.g., 85%, 90%, 95%, 96%, 97%, 98%, 99% and any increment therein) sequence identity to the light chain sequence set forth in SEQ ID NO: 95 and heavy chains of anti-Galectin-9 antibodies consist of an amino acid sequence that has at least 80% (e.g., 85%, 90%, 95%, 96%, 97%, 98%, 99% and any increment therein) sequence identity to the heavy chain sequence set forth in SEQ ID NO: 242. In some embodiments, light chains of anti-Galectin-9 antibodies comprise an amino acid sequence set forth in SEQ ID NO: 95 (or their variable regions) and heavy chains of anti-Galectin-9 antibodies comprise an amino acid sequence set forth in SEQ ID NO: 242 (or its variable region). In some embodiments, light chains of anti-Galectin-9 antibodies consist of the amino acid sequence set forth in SEQ ID NO: 95 and heavy chains of anti-Galectin-9 antibodies consist of an amino acid sequence set forth in SEQ ID NO: 242.

In some embodiments, the anti-Galectin-9 antibodies or antigen-binding portion thereof comprise a light chain sequence of SEQ ID NO: 95 and comprise a heavy chain sequence of SEQ ID NO: 295. In some embodiments, light chains of anti-Galectin-9 antibodies comprise an amino acid sequence that has at least 80% (e.g., 85%, 90%, 95%, 96%, 97%, 98%, 99% and any increment therein) sequence identity to the light chain sequence set forth in SEQ ID NO: 95 (or their variable regions) and heavy chains of anti-Galectin-9 antibodies comprise an amino acid sequence that has at least 80% (e.g., 85%, 90%, 95%, 96%, 97%, 98%, 99% and any increment therein) sequence identity to the heavy chain sequence set forth in SEQ ID NO: 295 (or its variable region). In some embodiments, light chains of anti-Galectin-9 antibodies consist of an amino acid sequence that has at least 80% (e.g., 85%, 90%, 95%, 96%, 97%, 98%, 99% and any increment therein) sequence identity to the light chain sequence set forth in SEQ ID NO: 95 and heavy chains of anti-Galectin-9 antibodies consist of an amino acid sequence that has at least 80% (e.g., 85%, 90%, 95%, 96%, 97%, 98%, 99% and any increment therein) sequence identity to the heavy chain sequence set forth in SEQ ID NO: 295. In some embodiments, light chains of anti-Galectin-9 antibodies comprise an amino acid sequence set forth in SEQ ID NO: 95 (or their variable regions) and heavy chains of anti-Galectin-9 antibodies comprise an amino acid sequence set forth in SEQ ID NO: 295. In some embodiments, light chains of anti-Galectin-9 antibodies consist of the amino acid sequence set forth in SEQ ID NO: 95 and heavy chains of anti-Galectin-9 antibodies consist of an amino acid sequence set forth in SEQ ID NO: 295.

Clone 9.2-Derived Light Chains

In some embodiments, light chains of anti-Galectin-9 antibodies comprise an amino acid sequence that has at least 80% (e.g., 85%, 90%, 95%, 96%, 97%, 98%, 99% and any increment therein) sequence identity to any of the light chains set forth herein (or their variable regions), (e.g., light chain sequences set forth in SEQ ID NO: 99-115). In some embodiments, light chains of anti-Galectin-9 antibodies consist of an amino acid sequence that has at least 80% (e.g., 85%, 90%, 95%, 96%, 97%, 98%, 99% and any increment therein) sequence identity to any of the light chains set forth herein, (e.g., light chain sequences set forth in SEQ ID NO: 99-115).

In some embodiments, light chains of anti-Galectin-9 antibodies comprise an amino acid sequence set forth in SEQ ID NO: 99-115. In some embodiments, light chains of anti-Galectin-9 antibodies consist of a sequence set forth in SEQ ID NO: 99-115.

In some embodiments, the anti-Galectin-9 antibodies or antigen-binding portion thereof comprise a light chain sequence of SEQ ID NO: 99. In some embodiments, the anti-Galectin-9 antibodies or antigen-binding portion thereof comprise a light chain sequence of SEQ ID NO: 100. In some embodiments, the anti-Galectin-9 antibodies or antigen-binding portion thereof comprise a light chain sequence of SEQ ID NO: 101. In some embodiments, the anti-Galectin-9 antibodies or antigen-binding portion thereof comprise a light chain sequence of SEQ ID NO: 102. In some embodiments, the anti-Galectin-9 antibodies or antigen-binding portion thereof comprise a light chain sequence of SEQ ID NO: 103. In some embodiments, the anti-Galectin-9 antibodies or antigen-binding portion thereof comprise a light chain sequence of SEQ ID NO: 104.

In some embodiments, the anti-Galectin-9 antibodies or antigen-binding portion thereof comprise a light chain sequence of SEQ ID NO: 105. In some embodiments, the anti-Galectin-9 antibodies or antigen-binding portion thereof comprise a light chain sequence of SEQ ID NO: 106. In some embodiments, the anti-Galectin-9 antibodies or antigen-binding portion thereof comprise a light chain sequence of SEQ ID NO: 107. In some embodiments, the anti-Galectin-9 antibodies or antigen-binding portion thereof comprise a light chain sequence of SEQ ID NO: 108. In some embodiments, the anti-Galectin-9 antibodies or antigen-binding portion thereof comprise a light chain sequence of SEQ ID NO: 109. In some embodiments, the anti-Galectin-9 antibodies or antigen-binding portion thereof comprise a light chain sequence of SEQ ID NO: 110. In some embodiments, the anti-Galectin-9 antibodies or antigen-binding portion thereof comprise a light chain sequence of SEQ ID NO: 111. In some embodiments, the anti-Galectin-9 antibodies or antigen-binding portion thereof comprise a light chain sequence of SEQ ID NO: 112. In some embodiments, the anti-Galectin-9 antibodies or antigen-binding portion thereof comprise a light chain sequence of SEQ ID NO: 113. In some embodiments, the anti-Galectin-9 antibodies or antigen-binding portion thereof comprise a light chain sequence of SEQ ID NO: 114. In some embodiments, the anti-Galectin-9 antibodies or antigen-binding portion thereof comprise a light chain sequence of SEQ ID NO: 115. In some embodiments, light chains of anti-Galectin-9 antibodies comprise an amino acid sequence that has at least 80% (e.g., 85%, 90%, 95%, 96%, 97%, 98%, 99% and any increment therein) sequence identity to the light chain sequence set forth in SEQ ID NO: 108 (or their variable regions). In some embodiments, light chains of anti-Galectin-9 antibodies consist of an amino acid sequence that has at least 80% (e.g., 85%, 90%, 95%, 96%, 97%, 98%, 99% and any increment therein) sequence identity to the light chain sequence set forth in SEQ ID NO: 108.

In some embodiments, light chains of anti-Galectin-9 antibodies comprise an amino acid sequence set forth in SEQ ID NO: 108 (or their variable regions). In some embodiments, light chains of anti-Galectin-9 antibodies consist set forth in SEQ ID NO: 108.

Clone 9.2-Derived Heavy Chains

In some embodiments, the amino acid sequences of exemplary anti-Galectin antibody heavy chains correspond to sequences set forth in SEQ ID NO: 141-168 (hIgG1); 194-221 (hIgG1 LALA); 247-274 (hIgG4); 300-327 (hIgG4 exchange mut) (anti-Galectin-9 antibodies binding to CRD2) for the heavy chains.

In some embodiments, heavy chains of anti-Galectin-9 antibodies comprise an amino acid sequence that has at least 80% (e.g., 85%, 90%, 95%, 96%, 97%, 98%, 99% and any increment therein) sequence identity to any of the heavy chains set forth herein (or their variable regions), e.g., sequences set forth in SEQ ID NO: 141-168; 194-220; 247-274; 300-327 (anti-Galectin-9 antibodies binding to CRD2). In some embodiments, heavy chains of anti-Galectin-9 antibodies consist of an amino acid sequence that has at least 80% (e.g., 85%, 90%, 95%, 96%, 97%, 98%, 99% and any increment therein) sequence identity to any of the heavy chains set forth herein, e.g., sequences set forth in SEQ ID NO: 141-168; 194-220; 247-274; 300-327 (anti-Galectin-9 antibodies binding to CRD2).

In some embodiments, heavy chains of anti-Galectin-9 antibodies comprise an heavy chain amino acid sequence set forth in SEQ ID NO: 141-168; 194-220; 247-274; 300-327 (anti-Galectin-9 antibodies binding to CRD2). In some embodiments, heavy chains of anti-Galectin-9 antibodies consist of an amino acid sequence set forth in SEQ ID NO: 141-168; 194-220; 247-274; 300-327 (anti-Galectin-9 antibodies binding to CRD2).

In some embodiments, the constant region is IgG1. In some embodiments, the anti-Galectin-9 antibodies or antigen-binding portion thereof comprise a heavy chain sequence of SEQ ID NO: 141. In some embodiments, the anti-Galectin-9 antibodies or antigen-binding portion thereof comprise a heavy chain sequence of SEQ ID NO: 142. In some embodiments, the anti-Galectin-9 antibodies or antigen-binding portion thereof comprise a heavy chain sequence of SEQ ID NO: 143. In some embodiments, the anti-Galectin-9 antibodies or antigen-binding portion thereof comprise a heavy chain sequence of SEQ ID NO: 144. In some embodiments, the anti-Galectin-9 antibodies or antigen-binding portion thereof comprise a heavy chain sequence of SEQ ID NO: 145. In some embodiments, the anti-Galectin-9 antibodies or antigen-binding portion thereof comprise a heavy chain sequence of SEQ ID NO: 146. In some embodiments, the anti-Galectin-9 antibodies or antigen-binding portion thereof comprise a heavy chain sequence of SEQ ID NO: 147. In some embodiments, the anti-Galectin-9 antibodies or antigen-binding portion thereof comprise a heavy chain sequence of SEQ ID NO: 148. In some embodiments, the anti-Galectin-9 antibodies or antigen-binding portion thereof comprise a heavy chain sequence of SEQ ID NO: 149. In some embodiments, the anti-Galectin-9 antibodies or antigen-binding portion thereof comprise a heavy chain sequence of SEQ ID NO: 150. In some embodiments, the anti-Galectin-9 antibodies or antigen-binding portion thereof comprise a heavy chain sequence of SEQ ID NO: 151. In some embodiments, the anti-Galectin-9 antibodies or antigen-binding portion thereof comprise a heavy chain sequence of SEQ ID NO: 152. In some embodiments, the anti-Galectin-9 antibodies or antigen-binding portion thereof comprise a heavy chain sequence of SEQ ID NO: 153. In some embodiments, the anti-Galectin-9 antibodies or antigen-binding portion thereof comprise a heavy chain sequence of SEQ ID NO: 154. In some embodiments, the anti-Galectin-9 antibodies or antigen-binding portion thereof comprise a heavy chain sequence of SEQ ID NO: 155. In some embodiments, the anti-Galectin-9 antibodies or antigen-binding portion thereof comprise a heavy chain sequence of SEQ ID NO: 156. In some embodiments, the anti-Galectin-9 antibodies or antigen-binding portion thereof comprise a heavy chain sequence of SEQ ID NO: 157. In some embodiments, the anti-Galectin-9 antibodies or antigen-binding portion thereof comprise a heavy chain sequence of SEQ ID NO: 158. In some embodiments, the anti-Galectin-9 antibodies or antigen-binding portion thereof comprise a heavy chain sequence of SEQ ID NO: 159. In some embodiments, the anti-Galectin-9 antibodies or antigen-binding portion thereof comprise a heavy chain sequence of SEQ ID NO: 160. In some embodiments, the anti-Galectin-9 antibodies or antigen-binding portion thereof comprise a heavy chain sequence of SEQ ID NO: 161. In some embodiments, the anti-Galectin-9 antibodies or antigen-binding portion thereof comprise a heavy chain sequence of SEQ ID NO: 162. In some embodiments, the anti-Galectin-9 antibodies or antigen-binding portion thereof comprise a heavy chain sequence of SEQ ID NO: 163. In some embodiments, the anti-Galectin-9 antibodies or antigen-binding portion thereof comprise a heavy chain sequence of SEQ ID NO: 164. In some embodiments, the anti-Galectin-9 antibodies or antigen-binding portion thereof comprise a heavy chain sequence of SEQ ID NO: 165. In some embodiments, the anti-Galectin-9 antibodies or antigen-binding portion thereof comprise a heavy chain sequence of SEQ ID NO: 166. In some embodiments, the anti-Galectin-9 antibodies or antigen-binding portion thereof comprise a heavy chain sequence of SEQ ID NO: 167. In some embodiments, the anti-Galectin-9 antibodies or antigen-binding portion thereof comprise a heavy chain sequence of SEQ ID NO: 168.

In some embodiments, the constant region is IgG1 LALA. In some embodiments, the anti-Galectin-9 antibodies or antigen-binding portion thereof comprise a heavy chain sequence of SEQ ID NO: 194. In some embodiments, the anti-Galectin-9 antibodies or antigen-binding portion thereof comprise a heavy chain sequence of SEQ ID NO: 195. In some embodiments, the anti-Galectin-9 antibodies or antigen-binding portion thereof comprise a heavy chain sequence of SEQ ID NO: 196. In some embodiments, the anti-Galectin-9 antibodies or antigen-binding portion thereof comprise a heavy chain sequence of SEQ ID NO: 197. In some embodiments, the anti-Galectin-9 antibodies or antigen-binding portion thereof comprise a heavy chain sequence of SEQ ID NO: 198. In some embodiments, the anti-Galectin-9 antibodies or antigen-binding portion thereof comprise a heavy chain sequence of SEQ ID NO: 199. In some embodiments, the anti-Galectin-9 antibodies or antigen-binding portion thereof comprise a heavy chain sequence of SEQ ID NO: 200. In some embodiments, the anti-Galectin-9 antibodies or antigen-binding portion thereof comprise a heavy chain sequence of SEQ ID NO: 201. In some embodiments, the anti-Galectin-9 antibodies or antigen-binding portion thereof comprise a heavy chain sequence of SEQ ID NO: 202. In some embodiments, the anti-Galectin-9 antibodies or antigen-binding portion thereof comprise a heavy chain sequence of SEQ ID NO: 203. In some embodiments, the anti-Galectin-9 antibodies or antigen-binding portion thereof comprise a heavy chain sequence of SEQ ID NO: 304. In some embodiments, the anti-Galectin-9 antibodies or antigen-binding portion thereof comprise a heavy chain sequence of SEQ ID NO: 205. In some embodiments, the anti-Galectin-9 antibodies or antigen-binding portion thereof comprise a heavy chain sequence of SEQ ID NO: 206. In some embodiments, the anti-Galectin-9 antibodies or antigen-binding portion thereof comprise a heavy chain sequence of SEQ ID NO: 207. In some embodiments, the anti-Galectin-9 antibodies or antigen-binding portion thereof comprise a heavy chain sequence of SEQ ID NO: 208. In some embodiments, the anti-Galectin-9 antibodies or antigen-binding portion thereof comprise a heavy chain sequence of SEQ ID NO: 209. In some embodiments, the anti-Galectin-9 antibodies or antigen-binding portion thereof comprise a heavy chain sequence of SEQ ID NO: 210. In some embodiments, the anti-Galectin-9 antibodies or antigen-binding portion thereof comprise a heavy chain sequence of SEQ ID NO: 211. In some embodiments, the anti-Galectin-9 antibodies or antigen-binding portion thereof comprise a heavy chain sequence of SEQ ID NO: 212. In some embodiments, the anti-Galectin-9 antibodies or antigen-binding portion thereof comprise a heavy chain sequence of SEQ ID NO: 213. In some embodiments, the anti-Galectin-9 antibodies or antigen-binding portion thereof comprise a heavy chain sequence of SEQ ID NO: 214. In some embodiments, the anti-Galectin-9 antibodies or antigen-binding portion thereof comprise a heavy chain sequence of SEQ ID NO: 215. In some embodiments, the anti-Galectin-9 antibodies or antigen-binding portion thereof comprise a heavy chain sequence of SEQ ID NO: 216. In some embodiments, the anti-Galectin-9 antibodies or antigen-binding portion thereof comprise a heavy chain sequence of SEQ ID NO: 217. In some embodiments, the anti-Galectin-9 antibodies or antigen-binding portion thereof comprise a heavy chain sequence of SEQ ID NO: 218. In some embodiments, the anti-Galectin-9 antibodies or antigen-binding portion thereof comprise a heavy chain sequence of SEQ ID NO: 219. In some embodiments, the anti-Galectin-9 antibodies or antigen-binding portion thereof comprise a heavy chain sequence of SEQ ID NO: 220. In some embodiments, the anti-Galectin-9 antibodies or antigen-binding portion thereof comprise a heavy chain sequence of SEQ ID NO: 221.

In some embodiments, the constant region is IgG4. In some embodiments, the anti-Galectin-9 antibodies or antigen-binding portion thereof comprise a heavy chain sequence of SEQ ID NO: 247. In some embodiments, the anti-Galectin-9 antibodies or antigen-binding portion thereof comprise a heavy chain sequence of SEQ ID NO: 248. In some embodiments, the anti-Galectin-9 antibodies or antigen-binding portion thereof comprise a heavy chain sequence of SEQ ID NO: 249. In some embodiments, the anti-Galectin-9 antibodies or antigen-binding portion thereof comprise a heavy chain sequence of SEQ ID NO: 250. In some embodiments, the anti-Galectin-9 antibodies or antigen-binding portion thereof comprise a heavy chain sequence of SEQ ID NO: 251. In some embodiments, the anti-Galectin-9 antibodies or antigen-binding portion thereof comprise a heavy chain sequence of SEQ ID NO: 252. In some embodiments, the anti-Galectin-9 antibodies or antigen-binding portion thereof comprise a heavy chain sequence of SEQ ID NO: 253. In some embodiments, the anti-Galectin-9 antibodies or antigen-binding portion thereof comprise a heavy chain sequence of SEQ ID NO: 254. In some embodiments, the anti-Galectin-9 antibodies or antigen-binding portion thereof comprise a heavy chain sequence of SEQ ID NO: 255. In some embodiments, the anti-Galectin-9 antibodies or antigen-binding portion thereof comprise a heavy chain sequence of SEQ ID NO: 256. In some embodiments, the anti-Galectin-9 antibodies or antigen-binding portion thereof comprise a heavy chain sequence of SEQ ID NO: 257. In some embodiments, the anti-Galectin-9 antibodies or antigen-binding portion thereof comprise a heavy chain sequence of SEQ ID NO: 258. In some embodiments, the anti-Galectin-9 antibodies or antigen-binding portion thereof comprise a heavy chain sequence of SEQ ID NO: 259. In some embodiments, the anti-Galectin-9 antibodies or antigen-binding portion thereof comprise a heavy chain sequence of SEQ ID NO: 260. In some embodiments, the anti-Galectin-9 antibodies or antigen-binding portion thereof comprise a heavy chain sequence of SEQ ID NO: 261. In some embodiments, the anti-Galectin-9 antibodies or antigen-binding portion thereof comprise a heavy chain sequence of SEQ ID NO: 262. In some embodiments, the anti-Galectin-9 antibodies or antigen-binding portion thereof comprise a heavy chain sequence of SEQ ID NO: 263. In some embodiments, the anti-Galectin-9 antibodies or antigen-binding portion thereof comprise a heavy chain sequence of SEQ ID NO: 264. In some embodiments, the anti-Galectin-9 antibodies or antigen-binding portion thereof comprise a heavy chain sequence of SEQ ID NO: 265. In some embodiments, the anti-Galectin-9 antibodies or antigen-binding portion thereof comprise a heavy chain sequence of SEQ ID NO: 266. In some embodiments, the anti-Galectin-9 antibodies or antigen-binding portion thereof comprise a heavy chain sequence of SEQ ID NO: 267. In some embodiments, the anti-Galectin-9 antibodies or antigen-binding portion thereof comprise a heavy chain sequence of SEQ ID NO: 268. In some embodiments, the anti-Galectin-9 antibodies or antigen-binding portion thereof comprise a heavy chain sequence of SEQ ID NO: 269. In some embodiments, the anti-Galectin-9 antibodies or antigen-binding portion thereof comprise a heavy chain sequence of SEQ ID NO: 270. In some embodiments, the anti-Galectin-9 antibodies or antigen-binding portion thereof comprise a heavy chain sequence of SEQ ID NO: 271. In some embodiments, the anti-Galectin-9 antibodies or antigen-binding portion thereof comprise a heavy chain sequence of SEQ ID NO: 272. In some embodiments, the anti-Galectin-9 antibodies or antigen-binding portion thereof comprise a heavy chain sequence of SEQ ID NO: 273. In some embodiments, the anti-Galectin-9 antibodies or antigen-binding portion thereof comprise a heavy chain sequence of SEQ ID NO: 274.

In some embodiments, the constant region is IgG4 mut. In some embodiments, the anti-Galectin-9 antibodies or antigen-binding portion thereof comprise a heavy chain sequence of SEQ ID NO: 300. In some embodiments, the anti-Galectin-9 antibodies or antigen-binding portion thereof comprise a heavy chain sequence of SEQ ID NO: 301. In some embodiments, the anti-Galectin-9 antibodies or antigen-binding portion thereof comprise a heavy chain sequence of SEQ ID NO: 302. In some embodiments, the anti-Galectin-9 antibodies or antigen-binding portion thereof comprise a heavy chain sequence of SEQ ID NO: 303. In some embodiments, the anti-Galectin-9 antibodies or antigen-binding portion thereof comprise a heavy chain sequence of SEQ ID NO: 304. In some embodiments, the anti-Galectin-9 antibodies or antigen-binding portion thereof comprise a heavy chain sequence of SEQ ID NO: 305. In some embodiments, the anti-Galectin-9 antibodies or antigen-binding portion thereof comprise a heavy chain sequence of SEQ ID NO: 306. In some embodiments, the anti-Galectin-9 antibodies or antigen-binding portion thereof comprise a heavy chain sequence of SEQ ID NO: 307. In some embodiments, the anti-Galectin-9 antibodies or antigen-binding portion thereof comprise a heavy chain sequence of SEQ ID NO: 308. In some embodiments, the anti-Galectin-9 antibodies or antigen-binding portion thereof comprise a heavy chain sequence of SEQ ID NO: 309. In some embodiments, the anti-Galectin-9 antibodies or antigen-binding portion thereof comprise a heavy chain sequence of SEQ ID NO: 310. In some embodiments, the anti-Galectin-9 antibodies or antigen-binding portion thereof comprise a heavy chain sequence of SEQ ID NO: 311. In some embodiments, the anti-Galectin-9 antibodies or antigen-binding portion thereof comprise a heavy chain sequence of SEQ ID NO: 312. In some embodiments, the anti-Galectin-9 antibodies or antigen-binding portion thereof comprise a heavy chain sequence of SEQ ID NO: 313. In some embodiments, the anti-Galectin-9 antibodies or antigen-binding portion thereof comprise a heavy chain sequence of SEQ ID NO: 314. In some embodiments, the anti-Galectin-9 antibodies or antigen-binding portion thereof comprise a heavy chain sequence of SEQ ID NO: 315. In some embodiments, the anti-Galectin-9 antibodies or antigen-binding portion thereof comprise a heavy chain sequence of SEQ ID NO: 316. In some embodiments, the anti-Galectin-9 antibodies or antigen-binding portion thereof comprise a heavy chain sequence of SEQ ID NO: 317. In some embodiments, the anti-Galectin-9 antibodies or antigen-binding portion thereof comprise a heavy chain sequence of SEQ ID NO: 318. In some embodiments, the anti-Galectin-9 antibodies or antigen-binding portion thereof comprise a heavy chain sequence of SEQ ID NO: 319. In some embodiments, the anti-Galectin-9 antibodies or antigen-binding portion thereof comprise a heavy chain sequence of SEQ ID NO: 320. In some embodiments, the anti-Galectin-9 antibodies or antigen-binding portion thereof comprise a heavy chain sequence of SEQ ID NO: 321. In some embodiments, the anti-Galectin-9 antibodies or antigen-binding portion thereof comprise a heavy chain sequence of SEQ ID NO: 322. In some embodiments, the anti-Galectin-9 antibodies or antigen-binding portion thereof comprise a heavy chain sequence of SEQ ID NO: 323. In some embodiments, the anti-Galectin-9 antibodies or antigen-binding portion thereof comprise a heavy chain sequence of SEQ ID NO: 324. In some embodiments, the anti-Galectin-9 antibodies or antigen-binding portion thereof comprise a heavy chain sequence of SEQ ID NO: 325. In some embodiments, the anti-Galectin-9 antibodies or antigen-binding portion thereof comprise a heavy chain sequence of SEQ ID NO: 326.

In some embodiments, heavy chains of anti-Galectin-9 antibodies comprise an amino acid sequence that has at least 80% (e.g., 85%, 90%, 95%, 96%, 97%, 98%, 99% and any increment therein) sequence identity to the heavy chain sequence set forth in SEQ ID NO: 157 (or its variable region). In some embodiments, heavy chains of anti-Galectin-9 antibodies consist of an amino acid sequence that has at least 80% (e.g., 85%, 90%, 95%, 96%, 97%, 98%, 99% and any increment therein) sequence identity to the heavy chain sequence set forth in SEQ ID NO: 157. In some embodiments, heavy chains of anti-Galectin-9 antibodies comprise an amino acid sequence set forth in SEQ ID NO: 157 (or its variable region). In some embodiments, heavy chains of anti-Galectin-9 antibodies consist of an amino acid sequence set forth in SEQ ID NO: 157.

In some embodiments, heavy chains of anti-Galectin-9 antibodies comprise an amino acid sequence that has at least 80% (e.g., 85%, 90%, 95%, 96%, 97%, 98%, 99% and any increment therein) sequence identity to the heavy chain sequence set forth in SEQ ID NO: 210 (or its variable region). In some embodiments, heavy chains of anti-Galectin-9 antibodies consist of an amino acid sequence that has at least 80% (e.g., 85%, 90%, 95%, 96%, 97%, 98%, 99% and any increment therein) sequence identity to the heavy chain sequence set forth in SEQ ID NO: 210. In some embodiments, heavy chains of anti-Galectin-9 antibodies comprise an amino acid sequence set forth in SEQ ID NO: 210 (or its variable region). In some embodiments, heavy chains of anti-Galectin-9 antibodies consist of an amino acid sequence set forth in SEQ ID NO: 210. In some embodiments, heavy chains of anti-Galectin-9 antibodies comprise an amino acid sequence that has at least 80% (e.g., 85%, 90%, 95%, 96%, 97%, 98%, 99% and any increment therein) sequence identity to the heavy chain sequence set forth in SEQ ID NO: 263 (or its variable region). In some embodiments, heavy chains of anti-Galectin-9 antibodies consist of an amino acid sequence that has at least 80% (e.g., 85%, 90%, 95%, 96%, 97%, 98%, 99% and any increment therein) sequence identity to the heavy chain sequence set forth in SEQ ID NO: 263.

In some embodiments, heavy chains of anti-Galectin-9 antibodies comprise an amino acid sequence set forth in SEQ ID NO: 263 (or its variable region). In some embodiments, heavy chains of anti-Galectin-9 antibodies consist of an amino acid sequence set forth in SEQ ID NO: 263.

In some embodiments, heavy chains of anti-Galectin-9 antibodies comprise an amino acid sequence that has at least 80% (e.g., 85%, 90%, 95%, 96%, 97%, 98%, 99% and any increment therein) sequence identity to the heavy chain sequence set forth in SEQ ID NO: 316 (or its variable region). In some embodiments, heavy chains of anti-Galectin-9 antibodies consist of an amino acid sequence that has at least 80% (e.g., 85%, 90%, 95%, 96%, 97%, 98%, 99% and any increment therein) sequence identity to the heavy chain sequence set forth in SEQ ID NO: 316. In some embodiments, heavy chains of anti-Galectin-9 antibodies comprise an amino acid sequence set forth in SEQ ID NO: 316 (or its variable region). In some embodiments, heavy chains of anti-Galectin-9 antibodies consist of an amino acid sequence set forth in SEQ ID NO: 316.

Clone 9.2 Derived Heavy and Light Chains

In some embodiments, the amino acid sequences of exemplary anti-Galectin antibody light chains correspond to SEQ ID NO: 99-108, and the amino acid sequences of the exemplary anti-Galectin antibody heavy chains correspond to SEQ ID NO: 141-168; 194-221; 249-274; 300-327.

In some embodiments, the anti-Galectin-9 antibodies or antigen-binding portion thereof comprise a light chain having the sequence of SEQ ID NO: 99 and a heavy chain having a sequence selected from SEQ ID NO: 141, 194, 247, or 300.

In some embodiments, the anti-Galectin-9 antibodies or antigen-binding portion thereof comprise a light chain having the sequence of SEQ ID NO: 91 and a heavy chain having a sequence selected from SEQ ID NO: 142, 195, 248, or 301.

In some embodiments, the anti-Galectin-9 antibodies or antigen-binding portion thereof comprise a light chain having the sequence of SEQ ID NO: 91 and a heavy chain having a sequence selected from SEQ ID NO: 143, 196, 249, or 302.

In some embodiments, the anti-Galectin-9 antibodies or antigen-binding portion thereof comprise a light chain having the sequence of SEQ ID NO: 91 and a heavy chain having a sequence selected from SEQ ID NO: 144, 197, 250, or 303.

In some embodiments, the anti-Galectin-9 antibodies or antigen-binding portion thereof comprise a light chain having the sequence of SEQ ID NO: 100 and a heavy chain having a sequence selected from SEQ ID NO: 145, 198, 251, or 304.

In some embodiments, the anti-Galectin-9 antibodies or antigen-binding portion thereof comprise a light chain having the sequence of SEQ ID NO: 101 and a heavy chain having a sequence selected from SEQ ID NO: 146, 199, 252, or 305.

In some embodiments, the anti-Galectin-9 antibodies or antigen-binding portion thereof comprise a light chain having the sequence of SEQ ID NO: 102 and a heavy chain having a sequence selected from SEQ ID NO: 147, 200, 253, or 306.

In some embodiments, the anti-Galectin-9 antibodies or antigen-binding portion thereof comprise a light chain having the sequence of SEQ ID NO: 103 and a heavy chain having a sequence selected from SEQ ID NO: 148, 201, 254, or 307.

In some embodiments, the anti-Galectin-9 antibodies or antigen-binding portion thereof comprise a light chain having the sequence of SEQ ID NO: 104 and a heavy chain having a sequence selected from SEQ ID NO: 149, 202, 255, or 308.

In some embodiments, the anti-Galectin-9 antibodies or antigen-binding portion thereof comprise a light chain having the sequence of SEQ ID NO: 105 and a heavy chain having a sequence selected from SEQ ID NO: 150, 203, 256, or 309.

In some embodiments, the anti-Galectin-9 antibodies or antigen-binding portion thereof comprise a light chain having the sequence of SEQ ID NO: 106 and a heavy chain having a sequence selected from SEQ ID NO: 151, 204, 257, or 310.

In some embodiments, the anti-Galectin-9 antibodies or antigen-binding portion thereof comprise a light chain having the sequence of SEQ ID NO: 107 and a heavy chain having a sequence selected from SEQ ID NO: 152, 205, 258, or 311.

In some embodiments, the anti-Galectin-9 antibodies or antigen-binding portion thereof comprise a light chain having the sequence of SEQ ID NO: 99 and a heavy chain having a sequence selected from SEQ ID NO: 153, 206, 259, or 312.

In some embodiments, the anti-Galectin-9 antibodies or antigen-binding portion thereof comprise a light chain having the sequence of SEQ ID NO: 91 and a heavy chain having a sequence selected from SEQ ID NO: 154, 207, 260, or 313.

In some embodiments, the anti-Galectin-9 antibodies or antigen-binding portion thereof comprise a light chain having the sequence of SEQ ID NO: 100 and a heavy chain having a sequence selected from SEQ ID NO: 155, 208, 261, or 314.

In some embodiments, the anti-Galectin-9 antibodies or antigen-binding portion thereof comprise a light chain having the sequence of SEQ ID NO: 91 and a heavy chain having a sequence selected from SEQ ID NO: 156, 209, 262, or 315.

In some embodiments, the anti-Galectin-9 antibodies or antigen-binding portion thereof comprise a light chain having the sequence of SEQ ID NO: 108 and a heavy chain having a sequence selected from SEQ ID NO: 157, 210, 263, or 316.

In some embodiments, the anti-Galectin-9 antibodies or antigen-binding portion thereof comprise a light chain having the sequence of SEQ ID NO: 108 and a heavy chain having a sequence selected from SEQ ID NO: 158, 211, 264, or 317.

In some embodiments, the anti-Galectin-9 antibodies or antigen-binding portion thereof comprise a light chain having the sequence of SEQ ID NO: 91 and a heavy chain having a sequence selected from SEQ ID NO: 159, 212, 265, or 318.

In some embodiments, the anti-Galectin-9 antibodies or antigen-binding portion thereof comprise a light chain having the sequence of SEQ ID NO: 109 and a heavy chain having a sequence selected from SEQ ID NO: 160, 213, 266, or 319.

In some embodiments, the anti-Galectin-9 antibodies or antigen-binding portion thereof comprise a light chain having the sequence of SEQ ID NO: 108 and a heavy chain having a sequence selected from SEQ ID NO: 161, 214, 267, or 320.

In some embodiments, the anti-Galectin-9 antibodies or antigen-binding portion thereof comprise a light chain having the sequence of SEQ ID NO: 110 and a heavy chain having a sequence selected from SEQ ID NO: 162, 215, 268, or 321.

In some embodiments, the anti-Galectin-9 antibodies or antigen-binding portion thereof comprise a light chain having the sequence of SEQ ID NO: 111 and a heavy chain having a sequence selected from SEQ ID NO: 163, 216, 269, or 322.

In some embodiments, the anti-Galectin-9 antibodies or antigen-binding portion thereof comprise a light chain having the sequence of SEQ ID NO: 112 and a heavy chain having a sequence selected from SEQ ID NO: 164, 217, 270, or 323.

In some embodiments, the anti-Galectin-9 antibodies or antigen-binding portion thereof comprise a light chain having the sequence of SEQ ID NO: 113 and a heavy chain having a sequence selected from SEQ ID NO: 165, 218, 271, or 324.

In some embodiments, the anti-Galectin-9 antibodies or antigen-binding portion thereof comprise a light chain having the sequence of SEQ ID NO: 114 and a heavy chain having a sequence selected from SEQ ID NO: 166, 219, 272, or 325.

In some embodiments, the anti-Galectin-9 antibodies or antigen-binding portion thereof comprise a light chain having the sequence of SEQ ID NO: 115 and a heavy chain having a sequence selected from SEQ ID NO: 167, 220, 273, or 326.

In some embodiments, the anti-Galectin-9 antibodies or antigen-binding portion thereof comprise a light chain having the sequence of SEQ ID NO: 108 and a heavy chain having a sequence selected from SEQ ID NO: 168, 221, 274, or 327.

In some embodiments, the anti-Galectin-9 antibodies or antigen-binding portion thereof comprise a light chain sequence of SEQ ID NO: 108 and comprise a heavy chain sequence of SEQ ID NO: 157. In some embodiments, light chains of anti-Galectin-9 antibodies comprise an amino acid sequence that has at least 80% (e.g., 85%, 90%, 95%, 96%, 97%, 98%, 99% and any increment therein) sequence identity to the light chain sequence set forth in SEQ ID NO: 108 (or their variable regions), and heavy chains of anti-Galectin-9 antibodies comprise an amino acid sequence that has at least 80% (e.g., 85%, 90%, 95%, 96%, 97%, 98%, 99% and any increment therein) sequence identity to the heavy chain sequence set forth in SEQ ID NO: 157 (or its variable region). In some embodiments, light chains of anti-Galectin-9 antibodies consist of an amino acid sequence that has at least 80% (e.g., 85%, 90%, 95%, 96%, 97%, 98%, 99% and any increment therein) sequence identity to the light chain sequence set forth in SEQ ID NO: 108 and heavy chains of anti-Galectin-9 antibodies consist of an amino acid sequence that has at least 80% (e.g., 85%, 90%, 95%, 96%, 97%, 98%, 99% and any increment therein) sequence identity to the heavy chain sequence set forth in SEQ ID NO: 157. In some embodiments, light chains of anti-Galectin-9 antibodies comprise an amino acid sequence set forth in SEQ ID NO: 108 (or their variable regions) heavy chains of anti-Galectin-9 antibodies comprise an amino acid sequence set forth in SEQ ID NO: 157 (or its variable region). In some embodiments, light chains of anti-Galectin-9 antibodies consist of the amino acid sequence set forth in SEQ ID NO: 108 and heavy chains of anti-Galectin-9 antibodies consist of an amino acid sequence set forth in SEQ ID NO: 157.

In some embodiments, the anti-Galectin-9 antibodies or antigen-binding portion thereof comprise a light chain sequence of SEQ ID NO: 108 and comprise a heavy chain sequence of SEQ ID NO: 210. In some embodiments, light chains of anti-Galectin-9 antibodies comprise an amino acid sequence that has at least 80% (e.g., 85%, 90%, 95%, 96%, 97%, 98%, 99% and any increment therein) sequence identity to the light chain sequence set forth in SEQ ID NO: 108 (or their variable regions) and heavy chains of anti-Galectin-9 antibodies comprise an amino acid sequence that has at least 80% (e.g., 85%, 90%, 95%, 96%, 97%, 98%, 99% and any increment therein) sequence identity to the heavy chain sequence set forth in SEQ ID NO: 210 (or its variable region) and heavy chains of anti-Galectin-9 antibodies consist of an amino acid sequence that has at least 80% (e.g., 85%, 90%, 95%, 96%, 97%, 98%, 99% and any increment therein) sequence identity to the heavy chain sequence set forth in SEQ ID NO: 210. In some embodiments, light chains of anti-Galectin-9 antibodies consist of an amino acid sequence that has at least 80% (e.g., 85%, 90%, 95%, 96%, 97%, 98%, 99% and any increment therein) sequence identity to the light chain sequence set forth in SEQ ID NO: 108. In some embodiments, light chains of anti-Galectin-9 antibodies comprise an amino acid sequence set forth in SEQ ID NO: 108 (or their variable regions) and heavy chains of anti-Galectin-9 antibodies comprise an amino acid sequence set forth in SEQ ID NO: 210 (or its variable region). In some embodiments, light chains of anti-Galectin-9 antibodies consist of the amino acid sequence set forth in SEQ ID NO: 108 and heavy chains of anti-Galectin-9 antibodies comprise an amino acid sequence set forth in SEQ ID NO: 210.

In some embodiments, the anti-Galectin-9 antibodies or antigen-binding portion thereof comprise a light chain sequence of SEQ ID NO: 108 and comprise a heavy chain sequence of SEQ ID NO: 263. In some embodiments, light chains of anti-Galectin-9 antibodies comprise an amino acid sequence that has at least 80% (e.g., 85%, 90%, 95%, 96%, 97%, 98%, 99% and any increment therein) sequence identity to the light chain sequence set forth in SEQ ID NO: 108 (or their variable regions) and heavy chains of anti-Galectin-9 antibodies comprise an amino acid sequence that has at least 80% (e.g., 85%, 90%, 95%, 96%, 97%, 98%, 99% and any increment therein) sequence identity to the heavy chain sequence set forth in SEQ ID NO: 263 (or its variable region). In some embodiments, light chains of anti-Galectin-9 antibodies consist of an amino acid sequence that has at least 80% (e.g., 85%, 90%, 95%, 96%, 97%, 98%, 99% and any increment therein) sequence identity to the light chain sequence set forth in SEQ ID NO: 108 and heavy chains of anti-Galectin-9 antibodies consist of an amino acid sequence that has at least 80% (e.g., 85%, 90%, 95%, 96%, 97%, 98%, 99% and any increment therein) sequence identity to the heavy chain sequence set forth in SEQ ID NO: 263. In some embodiments, light chains of anti-Galectin-9 antibodies comprise an amino acid sequence set forth in SEQ ID NO: 108 (or their variable regions) and heavy chains of anti-Galectin-9 antibodies comprise an amino acid sequence set forth in SEQ ID NO: 263 (or its variable region). In some embodiments, light chains of anti-Galectin-9 antibodies consist of the amino acid sequence set forth in SEQ ID NO: 108 and heavy chains of anti-Galectin-9 antibodies consist of an amino acid sequence set forth in SEQ ID NO: 263.

In some embodiments, the anti-Galectin-9 antibodies or antigen-binding portion thereof comprise a light chain sequence of SEQ ID NO: 108 and comprise a heavy chain sequence of SEQ ID NO: 316. In some embodiments, light chains of anti-Galectin-9 antibodies comprise an amino acid sequence that has at least 80% (e.g., 85%, 90%, 95%, 96%, 97%, 98%, 99% and any increment therein) sequence identity to the light chain sequence set forth in SEQ ID NO: 108 (or their variable regions) and heavy chains of anti-Galectin-9 antibodies comprise an amino acid sequence that has at least 80% (e.g., 85%, 90%, 95%, 96%, 97%, 98%, 99% and any increment therein) sequence identity to the heavy chain sequence set forth in SEQ ID NO: 316 (or its variable region). In some embodiments, light chains of anti-Galectin-9 antibodies consist of an amino acid sequence that has at least 80% (e.g., 85%, 90%, 95%, 96%, 97%, 98%, 99% and any increment therein) sequence identity to the light chain sequence set forth in SEQ ID NO: 108 and heavy chains of anti-Galectin-9 antibodies consist of an amino acid sequence that has at least 80% (e.g., 85%, 90%, 95%, 96%, 97%, 98%, 99% and any increment therein) sequence identity to the heavy chain sequence set forth in SEQ ID NO: 316. In some embodiments, light chains of anti-Galectin-9 antibodies comprise an amino acid sequence set forth in SEQ ID NO: 108 (or their variable regions) and heavy chains of anti-Galectin-9 antibodies comprise an amino acid sequence set forth in SEQ ID NO: 316. In some embodiments, light chains of anti-Galectin-9 antibodies consist of the amino acid sequence set forth in SEQ ID NO: 108 and heavy chains of anti-Galectin-9 antibodies consist of an amino acid sequence set forth in SEQ ID NO: 316.

In some embodiments, the anti-Galectin-9 antibody comprises an IgG1 heavy chain having the sequence of SEQ ID NO: 157 and a light chain having the sequence of SEQ ID NO: 108. In some embodiments, the anti-Galectin-9 antibody comprises an IgG1 heavy chain having the sequence of SEQ ID NO: 210 and a light chain having the sequence of SEQ ID NO: 108. In some embodiments, the anti-Galectin-9 antibody comprises an IgG4 heavy chain having the sequence of SEQ ID NO: 263 and a light chain having the sequence of SEQ ID NO: 108. In some embodiments, the anti-Galectin-9 antibody comprises an IgG4 heavy chain having the sequence of SEQ ID NO: 316 and a light chain having the sequence of SEQ ID NO: 108. In some embodiments, the anti-Galectin-9 antibody comprises an IgG1 heavy chain having the sequence of SEQ ID NO: 136 and a light chain having the sequence of SEQ ID NO: 108. In some embodiments, the anti-Galectin-9 antibody comprises an IgG1 heavy chain having the sequence of SEQ ID NO: 189 and a light chain having the sequence of SEQ ID NO: 108. In some embodiments, the anti-Galectin-9 antibody comprises an IgG4 heavy chain having the sequence of SEQ ID NO: 242 and a light chain having the sequence of SEQ ID NO: 108. In some embodiments, the anti-Galectin-9 antibody comprises an IgG4 heavy chain having the sequence of SEQ ID NO: 295 and a light chain having the sequence of SEQ ID NO: 108.

Antibody heavy and light chain constant regions are well known in the art, e.g., those provided in the IMGT database (www.imgt.org) or at www.vbase2.org/vbstat.php., both of which are incorporated by reference herein.

Preparation of Anti-Galectin-9 Antibodies

Antibodies capable of binding Galectin-9 as described herein can be made by any method known in the art. See, for example, Harlow and Lane, (1998) Antibodies: A Laboratory Manual, Cold Spring Harbor Laboratory, New York.

In some embodiments, antibodies specific to a target antigen (e.g., Galectin-9 or a CRD thereof) are made by conventional hybridoma technology. The full-length target antigen or a fragment thereof, optionally coupled to a carrier protein such as KLH, can be used to immunize a host animal for generating antibodies binding to that antigen. The route and schedule of immunization of the host animal are generally in keeping with established and conventional techniques for antibody stimulation and production, as further described herein. General techniques for production of mouse, humanized, and human antibodies are known in the art and are described herein. It is contemplated that any mammalian subject including humans or antibody producing cells therefrom can be manipulated to serve as the basis for production of mammalian, including human hybridoma cell lines. Typically, the host animal is inoculated intraperitoneally, intramuscularly, orally, subcutaneously, intraplantar, and/or intradermally with an amount of immunogen, including as described herein.

Hybridomas can be prepared from the lymphocytes and immortalized myeloma cells using the general somatic cell hybridization technique of Kohler, B. and Milstein, C. (1975) Nature 256:495-497 or as modified by Buck, D. W., et al., In Vitro, 18:377-381 (1982). Available myeloma lines, including, but not limited to, X63-Ag8.653 and those from the Salk Institute, Cell Distribution Center, San Diego, Calif., USA, may be used in the hybridization. Generally, the technique involves fusing myeloma cells and lymphoid cells using a fusogen such as polyethylene glycol, or by electrical means well known to those skilled in the art. After the fusion, the cells are separated from the fusion medium and grown in a selective growth medium, such as hypoxanthine-aminopterin-thymidine (HAT) medium, to eliminate unhybridized parent cells. Any of the media described herein, supplemented with or without serum, can be used for culturing hybridomas that secrete monoclonal antibodies. As another alternative to the cell fusion technique, EBV immortalized B cells may be used to produce the anti-Galectin-9 monoclonal antibodies described herein. The hybridomas are expanded and subcloned, if desired, and supernatants are assayed for anti-immunogen activity by conventional immunoassay procedures (e.g., radioimmunoassay, enzyme immunoassay, or fluorescence immunoassay).

Hybridomas that may be used as source of antibodies encompass all derivatives, progeny cells of the parent hybridomas that produce monoclonal antibodies capable of interfering with the Galectin-9 activity. Hybridomas that produce such antibodies may be grown in vitro or in vivo using known procedures. The monoclonal antibodies may be isolated from the culture media or body fluids, by conventional immunoglobulin purification procedures such as ammonium sulfate precipitation, gel electrophoresis, dialysis, chromatography, and ultrafiltration, if desired. Undesired activity if present, can be removed, for example, by running the preparation over adsorbents made of the immunogen attached to a solid phase and eluting or releasing the desired antibodies off the immunogen. Immunization of a host animal with a target antigen or a fragment containing the target amino acid sequence conjugated to a protein that is immunogenic in the species to be immunized, e.g., keyhole limpet hemocyanin, serum albumin, bovine thyroglobulin, or soybean trypsin inhibitor using a bifunctional or derivatizing agent, for example maleimidobenzoyl sulfosuccinimide ester (conjugation through cysteine residues), N-hydroxysuccinimide (through lysine residues), glutaraldehyde, succinic anhydride, SOCl, or R1N=C=NR, where R and R1 are different alkyl groups, can yield a population of antibodies (e.g., monoclonal antibodies).

If desired, an antibody (monoclonal or polyclonal) of interest (e.g., produced by a hybridoma) may be sequenced and the polynucleotide sequence may then be cloned into a vector for expression or propagation. The sequence encoding the antibody of interest may be maintained in vector in a host cell and the host cell can then be expanded and frozen for future use. In an alternative, the polynucleotide sequence may be used for genetic manipulation to "humanize" the antibody or to improve the affinity (affinity maturation), or other characteristics of the antibody. For example, the constant region may be engineered to more resemble human constant regions to avoid immune response if the antibody is used in clinical trials and treatments in humans. It may be desirable to genetically manipulate the antibody sequence to obtain greater affinity to the target antigen and greater efficacy in inhibiting the activity of Galectin-9. It will be apparent to one of skill in the art that one or more polynucleotide changes can be made to the antibody and still maintain its binding specificity to the target antigen.

In other embodiments, fully human antibodies are obtained using commercially available mice that have been engineered to express specific human immunoglobulin proteins. Transgenic animals that are designed to produce a more desirable (e.g., fully human antibodies) or more robust immune response may also be used for generation of humanized or human antibodies. Examples of such technology are Xenomouse® from Amgen, Inc. (Fremont, Calif.) and HuMAb-Mouse® and TC Mouse™ from Medarex, Inc. (Princeton, N.J.). In other embodiments, antibodies are made recombinantly by phage display or yeast technology. See, for example, U.S. Pat. Nos. 5,565,332; 5,580,717; 5,733,743; and 6,265,150; and Winter et al., (1994) *Annu. Rev. Immunol.* 12:433-455. In alternate embodiments, phage display technology (McCafferty et al., (1990) *Nature* 348: 552-553) is used to produce human antibodies and antibody fragments in vitro, from immunoglobulin variable (V) domain gene repertoires from unimmunized donors.

In alternate embodiments, antibodies capable of binding to the target antigens as described herein are isolated from a suitable antibody library. Antibody libraries, which contain a plurality of antibody components, can be used to identify antibodies that bind to a specific target antigen (e.g., the CRD1 or CRD2 of Galectin-9 in this case) following routine selection processes as known in the art. In the selection process, an antibody library can be probed with the target antigen or a fragment thereof and members of the library that are capable of binding to the target antigen can be isolated, typically by retention on a support. Such screening process may be performed by multiple rounds (e.g., including both positive and negative selections) to enrich the pool of antibodies capable of binding to the target antigen. Individual clones of the enriched pool can then be isolated and further characterized to identify those having desired binding activity and biological activity. Sequences of the heavy chain and light chain variable domains can also be determined via conventional methodology. There are a number of routine methods known in the art to identify and isolate antibodies capable of binding to the target antigens described herein, including phage display, yeast display, ribosomal display, or mammalian display technology.

As an example, phage displays typically use a covalent linkage to bind the protein (e.g., antibody) component to a bacteriophage coat protein. The linkage results from translation of a nucleic acid encoding the antibody component fused to the coat protein. The linkage can include a flexible peptide linker, a protease site, or an amino acid incorporated as a result of suppression of a stop codon. Phage display is described, for example, in U.S. Pat. No. 5,223,409; Smith (1985) *Science* 228:1315-1317; WO 92/18619; WO 91/17271; WO 92/20791; WO 92/15679; WO 93/01288; WO 92/01047; WO 92/09690; WO 90/02809; de Haard et al. (1999) *J. Biol. Chem* 274:18218-30; Hoogenboom et al. (1998) *Immunotechnology* 4:1-20; Hoogenboom et al. (2000) *Immunol Today* 2:371-8 and Hoet et al. (2005) *Nat Biotechnol.* 23(3)344-8. Additional suitable methods are described in Miller et al., *PloS One,* 2012, 7, e43746; Fellouse et al., *J Mol Biol,* 2007, 373, 924-940. Bacteriophage displaying the protein component can be grown and harvested using standard phage preparatory methods, e.g. PEG precipitation from growth media. After selection of individual display phages, the nucleic acid encoding the selected protein components can be isolated from cells infected with the selected phages or from the phage themselves, after amplification. Individual colonies or plaques can be selected, and then the nucleic acid may be isolated and sequenced.

Other display formats include cell-based display (see, e.g., WO 03/029456), protein-nucleic acid fusions (see, e.g., U.S. Pat. No. 6,207,446), ribosome display (See, e.g., Mattheakis et al. (1994) *Proc. Natl. Acad. Sci. USA* 91:9022 and Hanes et al. (2000) *Nat Biotechnol.* 18:1287-92; Hanes et al. (2000) *Methods Enzymol.* 328:404-30; and Schaffitzel et al. (1999) *J Immunol Methods.* 231(1-2):119-35), and *E. coli* periplasmic display (*J Immunol Methods.* 2005 Nov. 22; PMID: 16337958).

After display library members are isolated for binding to the target antigen, each isolated library member can be also tested for its ability to bind to a non-target molecule to evaluate its binding specificity. Examples of non-target molecules include streptavidin on magnetic beads, blocking agents such as bovine serum albumin, non-fat bovine milk, soy protein, any capturing or target immobilizing monoclonal antibody, or non-transfected cells which do not express the target. A high-throughput ELISA screen can be used to obtain the data, for example. The ELISA screen can also be used to obtain quantitative data for binding of each library member to the target as well as for cross species reactivity to related targets or subunits of the target antigen and also under different condition such as pH 6 or pH 7.5. The non-target and target binding data are compared (e.g., using a computer and software) to identify library members that specifically bind to the target.

After selecting candidate library members that bind to a target, each candidate library member can be further analyzed, e.g., to further characterize its binding properties for the target, e.g., Galectin-9. Each candidate library member can be subjected to one or more secondary screening assays. The assay can be for a binding property, a catalytic property, an inhibitory property, a physiological property (e.g., cytotoxicity, renal clearance, immunogenicity), a structural property (e.g., stability, conformation, oligomerization state) or another functional property. The same assay can be used repeatedly, but with varying conditions, e.g., to determine pH, ionic, or thermal sensitivities.

As appropriate, the assays can use a display library member directly, a recombinant polypeptide produced from the nucleic acid encoding the selected polypeptide, or a synthetic peptide synthesized based on the sequence of the selected polypeptide. In the case of selected Fabs, the Fabs can be evaluated or can be modified and produced as intact IgG proteins. Exemplary assays for binding properties are described below.

Binding proteins can also be evaluated using an ELISA assay. For example, each protein is contacted to a microtitre plate whose bottom surface has been coated with the target, e.g., a limiting amount of the target. The plate is washed with buffer to remove non-specifically bound polypeptides. Then the amount of the binding protein bound to the target on the plate is determined by probing the plate with an antibody that can recognize the binding protein, e.g., a tag or constant portion of the binding protein. The antibody is linked to a detection system (e.g., an enzyme such as alkaline phosphatase or horse radish peroxidase (HRP) which produces a colorimetric product when appropriate substrates are provided).

Alternatively, the ability of a binding protein described herein to bind a target antigen can be analyzed using a homogenous assay, i.e., after all components of the assay are added, additional fluid manipulations are not required. For example, fluorescence resonance energy transfer (FRET) can be used as a homogenous assay (see, for example, Lakowicz et al., U.S. Pat. No. 5,631,169; Stavrianopoulos, et al., U.S. Pat. No. 4,868,103). A fluorophore label on the first molecule (e.g., the molecule identified in the fraction) is selected such that its emitted fluorescent energy can be absorbed by a fluorescent label on a second molecule (e.g., the target) if the second molecule is in proximity to the first molecule. The fluorescent label on the second molecule fluoresces when it absorbs to the transferred energy. Since the efficiency of energy transfer between the labels is related to the distance separating the molecules, the spatial relationship between the molecules can be assessed. In a situation in which binding occurs between the molecules, the fluorescent emission of the 'acceptor' molecule label in the assay should be maximal. A binding event that is configured for monitoring by FRET can be conveniently measured through standard fluorometric detection means, e.g., using a fluorimeter. By titrating the amount of the first or second binding molecule, a binding curve can be generated to estimate the equilibrium binding constant.

Surface plasmon resonance (SPR) can be used to analyze the interaction of a binding protein and a target antigen. SPR or Biomolecular Interaction Analysis (BIA) detects biospecific interactions in real time, without labeling any of the interactants. Changes in the mass at the binding surface (indicative of a binding event) of the BIA chip result in alterations of the refractive index of light near the surface (the optical phenomenon of SPR). The changes in the refractivity generate a detectable signal, which are measured as an indication of real-time reactions between biological molecules. Methods for using SPR are described, for example, in U.S. Pat. No. 5,641,640; Raether, 1988, Surface Plasmons Springer Verlag; Sjolander and Urbaniczky, 1991, *Anal. Chem.* 63:2338-2345; Szabo et al., 1995, *Curr. Opin. Struct. Biol.* 5:699-705 and on-line resources provide by BIAcore International AB (Uppsala, Sweden).

Information from SPR can be used to provide an accurate and quantitative measure of the equilibrium dissociation constant ($K_D$), and kinetic parameters, including $K_{on}$ and $K_{off}$, for the binding of a binding protein to a target. Such data can be used to compare different biomolecules. For example, selected proteins from an expression library can be compared to identify proteins that have high affinity for the target or that have a slow $K_{off}$. This information can also be used to develop structure-activity relationships (SAR). For example, the kinetic and equilibrium binding parameters of matured versions of a parent protein can be compared to the parameters of the parent protein. Variant amino acids at given positions can be identified that correlate with particular binding parameters, e.g., high affinity and slow $K_{off}$. This information can be combined with structural modeling (e.g., using homology modeling, energy minimization, or structure determination by x-ray crystallography or NMR). As a result, an understanding of the physical interaction between the protein and its target can be formulated and used to guide other design processes.

As a further example, cellular assays may be used. Binding proteins can be screened for ability to bind to cells which transiently or stably express and display the target of interest on the cell surface. For example, Galectin-9 binding proteins can be fluorescently labeled and binding to Galectin-9 in the presence or absence of antagonistic antibody can be detected by a change in fluorescence intensity using flow cytometry e.g., a FACS machine.

Antigen-binding fragments of an intact antibody (full-length antibody) can be prepared via routine methods. For example, F(ab')2 fragments can be produced by pepsin digestion of an antibody molecule, and Fab fragments that can be generated by reducing the disulfide bridges of F(ab')2 fragments.

Genetically engineered antibodies, such as humanized antibodies, chimeric antibodies, single-chain antibodies, and bi-specific antibodies, can be produced via, e.g., conventional recombinant technology. In one example, DNA encoding a monoclonal antibodies specific to a target antigen can be readily isolated and sequenced using conventional procedures (e.g., by using oligonucleotide probes that are capable of binding specifically to genes encoding the heavy and light chains of the monoclonal antibodies). Once isolated, the DNA may be placed into one or more expression vectors, which are then transfected into host cells such as *E. coli* cells, simian COS cells, Chinese hamster ovary (CHO) cells, or myeloma cells that do not otherwise produce immunoglobulin protein, to obtain the synthesis of monoclonal antibodies in the recombinant host cells. See, e.g., PCT Publication No. WO 87/04462. The DNA can then be modified, for example, by substituting the coding sequence for human heavy and light chain constant domains in place of the homologous murine sequences, Morrison et al., (1984) *Proc. Nat. Acad. Sci.* 81:6851, or by covalently joining to the immunoglobulin coding sequence all or part of the coding sequence for a non-immunoglobulin polypeptide. In that manner, genetically engineered antibodies, such as "chimeric" or "hybrid" antibodies; can be prepared that have the binding specificity of a target antigen.

Techniques developed for the production of "chimeric antibodies" are well known in the art. See, e.g., Morrison et al. (1984) *Proc. Natl. Acad. Sci. USA* 81, 6851; Neuberger et al. (1984) *Nature* 312, 604; and Takeda et al. (1984) *Nature* 314:452.

Methods for constructing humanized antibodies are also well known in the art. See, e.g., Queen et al., *Proc. Natl. Acad. Sci. USA*, 86:10029-10033 (1989). In one example, variable regions of $V_H$ and $V_L$ of a parent non-human antibody are subjected to three-dimensional molecular modeling analysis following methods known in the art. Next, framework amino acid residues predicted to be important for the formation of the correct CDR structures are identified using the same molecular modeling analysis. In parallel, human $V_H$ and $V_L$ chains having amino acid sequences that are homologous to those of the parent non-human antibody are identified from any antibody gene database using the parent $V_H$ and $V_L$ sequences as search queries. Human $V_H$ and $V_L$ acceptor genes are then selected.

The CDR regions within the selected human acceptor genes can be replaced with the CDR regions from the parent non-human antibody or functional variants thereof. When necessary, residues within the framework regions of the parent chain that are predicted to be important in interacting with the CDR regions (see above description) can be used to substitute for the corresponding residues in the human acceptor genes.

A single-chain antibody can be prepared via recombinant technology by linking a nucleotide sequence coding for a heavy chain variable region and a nucleotide sequence coding for a light chain variable region. Preferably, a flexible linker is incorporated between the two variable regions. Alternatively, techniques described for the production of single chain antibodies (U.S. Pat. Nos. 4,946,778 and 4,704, 692) can be adapted to produce a phage or yeast scFv library and scFv clones specific to Galectin-9 can be identified from the library following routine procedures. Positive clones can be subjected to further screening to identify those that inhibit Galectin-9 activity.

Antibodies obtained following a method known in the art and described herein can be characterized using methods well known in the art. For example, one method is to identify the epitope to which the antigen binds, or "epitope mapping." There are many methods known in the art for mapping and characterizing the location of epitopes on proteins, including solving the crystal structure of an antibody-antigen complex, competition assays, gene fragment expression assays, and synthetic peptide-based assays, as described, for example, in Chapter 11 of Harlow and Lane, Using Antibodies, a Laboratory Manual, Cold Spring Harbor Laboratory Press, Cold Spring Harbor, N.Y., 1999. In an additional example, epitope mapping can be used to determine the sequence, to which an antibody binds. The epitope can be a linear epitope, i.e., contained in a single stretch of amino acids, or a conformational epitope formed by a three-dimensional interaction of amino acids that may not necessarily be contained in a single stretch (primary structure linear sequence). Peptides of varying lengths (e.g., at least 4-6 amino acids long) can be isolated or synthesized (e.g., recombinantly) and used for binding assays with an antibody. In another example, the epitope to which the antibody binds can be determined in a systematic screening by using overlapping peptides derived from the target antigen sequence and determining binding by the antibody. According to the gene fragment expression assays, the open reading frame encoding the target antigen is fragmented either randomly or by specific genetic constructions and the reactivity of the expressed fragments of the antigen with the antibody to be tested is determined. The gene fragments may, for example, be produced by PCR and then transcribed and translated into protein in vitro, in the presence of radioactive amino acids. The binding of the antibody to the radioactively labeled antigen fragments is then determined by immunoprecipitation and gel electrophoresis. Certain epitopes can also be identified by using large libraries of random peptide sequences displayed on the surface of phage particles (phage libraries). Alternatively, a defined library of overlapping peptide fragments can be tested for binding to the test antibody in simple binding assays. In an additional example, mutagenesis of an antigen binding domain, domain swapping experiments and alanine scanning mutagenesis can be performed to identify residues required, sufficient, and/or necessary for epitope binding. For example, domain swapping experiments can be performed using a mutant of a target antigen in which various fragments of the Galectin-9 polypeptide have been replaced (swapped) with sequences from a closely related, but antigenically distinct protein (such as another member of the β-galactoside-binding soluble lectin family). By assessing binding of the antibody to the mutant Galectin-9, the importance of the particular antigen fragment to antibody binding can be assessed.

Alternatively, competition assays can be performed using other antibodies known to bind to the same antigen to determine whether an antibody binds to the same epitope as the other antibodies. Competition assays are well known to those of skill in the art.

In some examples, an anti-Galectin-9 antibody is prepared by recombinant technology as exemplified below.

Nucleic acids encoding the heavy and light chain of an anti-Galectin-9 antibody as described herein can be cloned into one expression vector, each nucleotide sequence being in operable linkage to a suitable promoter. In one example, each of the nucleotide sequences encoding the heavy chain and light chain is in operable linkage to a distinct promoter. Alternatively, the nucleotide sequences encoding the heavy chain and the light chain can be in operable linkage with a single promoter, such that both heavy and light chains are expressed from the same promoter. When necessary, an internal ribosomal entry site (IRES) can be inserted between the heavy chain and light chain encoding sequences.

In some examples, the nucleotide sequences encoding the two chains of the antibody are cloned into two vectors, which can be introduced into the same or different cells. When the two chains are expressed in different cells, each of them can be isolated from the host cells expressing such and the isolated heavy chains and light chains can be mixed and incubated under suitable conditions allowing for the formation of the antibody.

Generally, a nucleic acid sequence encoding one or all chains of an antibody can be cloned into a suitable expression vector in operable linkage with a suitable promoter using methods known in the art. For example, the nucleotide sequence and vector can be contacted, under suitable conditions, with a restriction enzyme to create complementary ends on each molecule that can pair with each other and be joined together with a ligase. Alternatively, synthetic nucleic acid linkers can be ligated to the termini of a gene. These synthetic linkers contain nucleic acid sequences that correspond to a particular restriction site in the vector. The selection of expression vectors/promoter would depend on the type of host cells for use in producing the antibodies.

A variety of promoters can be used for expression of the antibodies described herein, including, but not limited to, cytomegalovirus (CMV) intermediate early promoter, a viral LTR such as the Rous sarcoma virus LTR, HIV-LTR, HTLV-1 LTR, the simian virus 40 (SV40) early promoter, *E. coli* lac UV5 promoter, and the herpes simplex tk virus promoter.

Regulatable promoters can also be used. Such regulatable promoters include those using the lac repressor from *E. coli* as a transcription modulator to regulate transcription from lac operator-bearing mammalian cell promoters [Brown, M. et al., *Cell,* 49:603-612 (1987)], those using the tetracycline repressor (tetR) [Gossen, M., and Bujard, H., *Proc. Natl. Acad. Sci. USA* 89:5547-5551 (1992); Yao, F. et al., *Human Gene Therapy,* 9:1939-1950 (1998); Shockelt, P., et al., *Proc. Natl. Acad. Sci. USA,* 92:6522-6526 (1995)]. Other systems include FK506 dimer, VP16 or p65 using astradiol, RU486, diphenol murislerone, or rapamycin. Inducible systems are available from Invitrogen, Clontech and Ariad.

Regulatable promoters that include a repressor with the operon can be used. In one embodiment, the lac repressor from *E. coli* can function as a transcriptional modulator to regulate transcription from lac operator-bearing mammalian cell promoters (M. Brown et al., *Cell,* 49:603-612 (1987); Gossen and Bujard (1992); M. Gossen et al., *Natl. Acad. Sci. USA,* 89:5547-5551 (1992)) combined the tetracycline repressor (tetR) with the transcription activator (VP 16) to create a tetR-mammalian cell transcription activator fusion protein, tTa (tetR-VP 16), with the tetO-bearing minimal promoter derived from the human cytomegalovirus (hCMV) major immediate-early promoter to create a tetR-tet operator system to control gene expression in mammalian cells. In one embodiment, a tetracycline inducible switch is used. The tetracycline repressor (tetR) alone, rather than the tetR-mammalian cell transcription factor fusion derivatives can function as potent trans-modulator to regulate gene expression in mammalian cells when the tetracycline operator is properly positioned downstream for the TATA element of the CMVIE promoter (Yao et al., *Human Gene Therapy*, 10(16):1392-1399 (2003)). One particular advantage of this tetracycline inducible switch is that it does not require the use of a tetracycline repressor-mammalian cells transactivator or repressor fusion protein, which in some instances can be toxic to cells (Gossen et al., *Natl. Acad. Sci. USA*, 89:5547-5551 (1992); Shockett et al., *Proc. Natl. Acad. Sci. USA*, 92:6522-6526 (1995)), to achieve its regulatable effects.

Additionally, the vector can contain, for example, some or all of the following: a selectable marker gene, such as the neomycin gene for selection of stable or transient transfectants in mammalian cells; enhancer/promoter sequences from the immediate early gene of human CMV for high levels of transcription; transcription termination and RNA processing signals from SV40 for mRNA stability; SV40 polyoma origins of replication and ColE1 for proper episomal replication; internal ribosome binding sites (IRESes), versatile multiple cloning sites; and T7 and SP6 RNA promoters for in vitro transcription of sense and antisense RNA. Suitable vectors and methods for producing vectors containing transgenes are well known and available in the art.

Examples of polyadenylation signals useful to practice the methods described herein include, but are not limited to, human collagen I polyadenylation signal, human collagen II polyadenylation signal, and SV40 polyadenylation signal.

One or more vectors (e.g., expression vectors) comprising nucleic acids encoding any of the antibodies may be introduced into suitable host cells for producing the antibodies. The host cells can be cultured under suitable conditions for expression of the antibody or any polypeptide chain thereof. Such antibodies or polypeptide chains thereof can be recovered by the cultured cells (e.g., from the cells or the culture supernatant) via a conventional method, e.g., affinity purification. If necessary, polypeptide chains of the antibody can be incubated under suitable conditions for a suitable period of time allowing for production of the antibody.

In some embodiments, methods for preparing an antibody described herein involve a recombinant expression vector that encodes both the heavy chain and the light chain of an anti-Galectin-9 antibody, as also described herein. The recombinant expression vector can be introduced into a suitable host cell (e.g., a dhfr– CHO cell) by a conventional method, e.g., calcium phosphate-mediated transfection. Positive transformant host cells can be selected and cultured under suitable conditions allowing for the expression of the two polypeptide chains that form the antibody, which can be recovered from the cells or from the culture medium. When necessary, the two chains recovered from the host cells can be incubated under suitable conditions allowing for the formation of the antibody.

In one example, two recombinant expression vectors are provided, one encoding the heavy chain of the anti-Galectin-9 antibody and the other encoding the light chain of the anti-Galectin-9 antibody. Both of the two recombinant expression vectors can be introduced into a suitable host cell (e.g., dhfr– CHO cell) by a conventional method, e.g., calcium phosphate-mediated transfection. Alternatively, each of the expression vectors can be introduced into a suitable host cells. Positive transformants can be selected and cultured under suitable conditions allowing for the expression of the polypeptide chains of the antibody. When the two expression vectors are introduced into the same host cells, the antibody produced therein can be recovered from the host cells or from the culture medium. If necessary, the polypeptide chains can be recovered from the host cells or from the culture medium and then incubated under suitable conditions allowing for formation of the antibody. When the two expression vectors are introduced into different host cells, each of them can be recovered from the corresponding host cells or from the corresponding culture media. The two polypeptide chains can then be incubated under suitable conditions for formation of the antibody.

Standard molecular biology techniques are used to prepare the recombinant expression vector, transfect the host cells, select for transformants, culture the host cells and recovery of the antibodies from the culture medium. For example, some antibodies can be isolated by affinity chromatography with a Protein A or Protein G coupled matrix.

Any of the nucleic acids encoding the heavy chain, the light chain, or both of an anti-Galectin-9 antibody as described herein, vectors (e.g., expression vectors) containing such; and host cells comprising the vectors are within the scope of the present disclosure.

Anti-Galectin-9 antibodies thus prepared can be can be characterized using methods known in the art, whereby reduction, amelioration, or neutralization of Galectin-9 biological activity is detected and/or measured. For example, an ELISA-type assay may be suitable for qualitative or quantitative measurement of Galectin-9 inhibition of Dectin-1 or TIM-3 signaling.

The bioactivity of an anti-Galectin-9 antibody can verified by incubating a candidate antibody with Dectin-1 and Galectin-9, and monitoring any one or more of the following characteristics: (a) binding between Dectin-1 and Galectin-9 and inhibition of the signaling transduction mediated by the binding; (b) preventing, ameliorating, or treating any aspect of a solid tumor; (c) blocking or decreasing Dectin-1 activation; (d) inhibiting (reducing) synthesis, production or release of Galectin-9. Alternatively, TIM-3 can be used to verify the bioactivity of an anti-Galectin-9 antibody using the protocol described above. Alternatively, CD206 can be used to verify the bioactivity of an anti-Galectin-9 antibody using the protocol described above.

Additional assays to determine bioactivity of an anti-Galectin-9 antibody include measurement of CD8+ and CD4+(conventional) T-cell activation (in an in vitro or in vivo assay, e.g., by measuring inflammatory cytokine levels, e.g., IFNgamma, TNFalpha, CD44, ICOS granzymeB, Perforin, IL2 (upregulation); CD26L and IL-10 (downregulation)); measurement of reprogramming of macrophages (in vitro or in vivo), e.g., from the M2 to the M1 phenotype (e.g., increased MHCII, reduced CD206, increased TNF-alpha and iNOS). Alternatively, levels of ADCC can be assessed, e.g., in an in vitro assay, as described herein.

Methods of Treatment

The present disclosure provides pharmaceutical compositions comprising at least one anti-Galectin-9 antibody described herein or antigen binding fragment thereof and uses of such for inhibiting or reducing a signaling mediated by Galectin-9 or eliminating or reducing Galectin-9 positive cells. Any of the anti-Galectin-9 antibodies described herein can be used in any of the methods described herein. In some embodiments, the anti-Galentin-9 antibody is selected from G9.1-1, G9.1-2, G9.1-3, G9.1-4, G9.1-5, G9.1-6, G9.1-7, G9.1-8, G9.1-9, G9.1-10, G9.1-11, G9.1-8m1, G9.1-8m2, G9.1-8m3, G9.1-8m4, G9.1-8m5, G9.1-8m6, G9.1-8m7, G9.1-8m8, G9.1-8m9, G9.1-8m10, G9.1-8m11, G9.1-8m12, G9.1-8m13, and G9.1-8m14, or combinations thereof. In some embodiments, the anti-Galectin-9 antibody is selected from G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, G9.2-26, and G9.2-low affinity binder, or combinations thereof. Non-limiting examples of such antibodies include for example antibody 9.2-17 or 9.1-8mut13. Such antibodies can be used for treating diseases associated with Galectin-9. In some aspects, the invention provides methods of treating cancer. In some embodiments, the present disclosure methods for reducing, ameliorating, or eliminating one or more symptom(s) associated with cancer.

In some embodiments, the disclosure provides a method for treating cancer in a subject, the method comprising administering to a subject in need thereof an effective amount of an anti-Galectin-9 antibody described herein or antigen binding fragment thereof. In some embodiments, the disclosure provides a method for treating cancer in a subject, the method comprising administering to a subject in need thereof an effective amount of a pharmaceutical composition comprising an anti-Galectin-9 antibody described herein or antigen binding fragment thereof. In some embodiments, the anti-Galectin-9 antibody is selected from the group consisting of G9.1-1, G9.1-2, G9.1-3, G9.1-4, G9.1-5, G9.1-6, G9.1-7, G9.1-8, G9.1-9, G9.1-10, G9.1-11, G9.1-8m1, G9.1-8m2, G9.1-8m3, G9.1-8m4, G9.1-8m5, G9.1-8m6, G9.1-8m7, G9.1- 8m8, G9.1-8m9, G9.1-8m10, G9.1-8m11, G9.1-8m12, G9.1-8m13, and G9.1-8m14 antibodies, or combinations thereof. In some embodiments, the anti-Galectin-9 antibody is selected from the group consisting of G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, G9.2-26, and G9.2-low affinity binder antibodies, or combinations thereof. Non-limiting examples of such antibodies include for example antibody 9.2-17 or 9.1-8mut13.

Given that pro-tumor action of Galectin-9 is mediated through interaction with immune cells (i.e., interactions with with lymphoid cells via TIM-3, CD44, and 41BB, and with macrophages via dectin-1 and CD206) and given that Galectin-9 is expressed in a large number of tumors, targeting Galectin-9, e.g., using a Galectin-9 binding antibody to inhibit interaction with its receptors, provides a therapeutic approach that can be applied across a variety of different tumor types.

In some embodiments, the cancer is selected from adrenal cancer, adrenocortical carcinoma, anal cancer, appendix cancer, bile duct cancer, bladder cancer, bone cancer (e.g., Ewing sarcoma tumors, osteosarcoma, malignant fibrous histiocytoma), brain cancer (e.g., astrocytomas, brain stem glioma, craniopharyngioma, ependymoma), bronchial tumors, cholangiocarcinoma, cholangiosarcoma, central nervous system tumors, breast cancer, Castleman disease, cervical cancer, colon cancer, rectal cancer, colorectal cancer, endometrial cancer, esophageal cancer, eye cancer, gallbladder cancer, gastrointestinal cancer, gastrointestinal carcinoid tumors, gastrointestinal stromal tumors, genitourinary cancers, gestational trophoblastic disease, heart cancer, Kaposi sarcoma, kidney cancer, laryngeal cancer, hypopharyngeal cancer, leukemia (e.g., acute lymphoblastic leukemia, acute myeloid leukemia, chronic lymphocytic leukemia, chronic myelogenous leukemia), liver cancer, lung cancer (for example, non-small cell lung cancer, NSCLC, and small cell lung cancer, SCLC), lymphoma (e.g., AIDS-related lymphoma, Burkitt lymphoma, cutaneous T cell lymphoma, Hogkin lymphoma, Non-Hogkin lymphoma, primary central nervous system lymphoma), malignant mesothelioma, multiple myeloma, myelodysplastic syndrome, nasal cavity cancer, paranasal sinus cancer, pancreatic duct adenocarcinoma (PDA) nasopharyngeal cancer, neuroblastoma, oral cavity cancer, oropharyngeal cancer, osteosarcoma, ovarian cancer, pancreatic cancer, penile cancer, pituitary tumors, prostate cancer, retinoblastoma, rhabdomyosarcoma, rhabdoid tumor, salivary gland cancer, sarcoma, skin cancer (e.g., basal cell carcinoma, melanoma), squamous cell head and neck cancer, small intestine cancer, stomach cancer, teratoid tumor, testicular cancer, throat cancer, thymus cancer, thyroid cancer, unusual childhood cancers, upper and lower gastrointestinal malignancies (including, but not limited to, esophageal, gastric, and hepatobiliary cancer), urethral cancer, uterine cancer, uterine sarcoma, vaginal cancer, vulvar cancer, Waldenstrom macroglobulinemia, and Wilms tumor. In some embodiments, the cancer is selected from hematological malignancies include acute lymphoblastic leukemia, chronic lymphocytic leukemia, lymphomas, multiple myeloma, acute myelogenous leukemia, chronic myelogenous leukemia, myelodysplastic syndromes and the myeloproliferative neoplasms, such as essential thrombocythemia, polycythemia vera, myelofibrosis, and gallbladder cancer (adenocarcinomas or squamous cell carcinoma). In some embodiments, the symptom(s) associated thereof include, but are not limited to, anemia, loss of appetite, irritation of bladder lining, bleeding and bruising (thrombocytopenia), changes in taste or smell, constipation, diarrhea, dry mouth, dysphagia, edema, fatigue, hair loss (alopecia), infection, infertility, lymphedema, mouth sores, nausea, pain, peripheral neuropathy, tooth decay, urinary tract infections, and/or problems with memory and concentration. The method may comprise preparing a pharmaceutical composition with an anti-Galectin-9 antibody described herein, and administering the pharmaceutical composition to a subject in a therapeutically effective amount.

In some embodiments, the disclosure provides a method for treating gall bladder cancer in a subject, the method comprising administering to a subject in need thereof an effective amount of an anti-Galectin-9 antibody described herein, e.g., in Table 1 or Table 2 herein, including but not limited to, 9.1-8m13 and/or 9.2-17, or an antigen binding fragment thereof.

In certain embodiments, administering the pharmaceutical composition, e.g., one or more of the anti-Galectin-9 antibodies described herein, e.g., in Table 1 and/or Table 2, including, but not limited to, 9.2-17 and 9.1-8m13, to the subject reduces cell proliferation, tumor growth, and/or tumor volume in a subject, or reduces the number of metastatic lesions over time. In some embodiments, administering the composition results in complete response, partial response, or stable disease.

Pancreatic ductal adenocarcinoma (PDA) is a devastating disease with few long-term survivors (Yadav et al., *Gastroenterology*, 2013, 144, 1252-1261). Inflammation is paramount in PDA progression as oncogenic mutations alone, in the absence of concomitant inflammation, are insufficient for tumorigenesis (Guerra et al., *Cancer Cell*, 2007, 11, 291-302). Innate and adaptive immunity cooperate to promote tumor progression in PDA. In particular, specific innate immune subsets within the tumor microenvironment (TME) are apt at educating adaptive immune effector cells towards a tumor-permissive phenotype. Antigen presenting cell (APC) populations, including M2-polarized tumor-associated macrophages (TAMs) and myeloid dendritic cells (DC), induce the generation of immune suppressive Th2 cells in favor of tumor-protective Th1 cells (Ochi et al., *J of Exp*

*Med.*, 2012, 209, 1671-1687; Zhu et al., *Cancer Res.*, 2014, 74, 5057-5069). Similarly, it has been shown that myeloid derived suppressor cells (MDSC) negate anti-tumor $CD8^+$ cytotoxic T-Lymphocyte (CTL) responses in PDA and promote metastatic progression (Connolly et al., *J Leuk Biol.*, 2010, 87, 713-725; Pylayeva-Gupta et al., *Cancer Cell*, 2012, 21, 836-847; Bayne et al., *Cancer Cell*, 2012, 21, 822-835).

Recently, dectin-1 on macrophages was shown to bind galectin-9 in pancreatic ductal adenocarcinoma (PDA) (Daley et al., 2017). Removal of dectin-1 signaling (in Dectin-/- mice) resulted in a decrease in tumor infiltration of M2 type (suppressive CD206+) macrophages. Additionally, antibody-based Galectin-9 neutralization only enhanced T cell activation in Dectin-1+/+ hosts, indicating that Galectin-9 exerts primary immune-suppressive effects specific to Dectin-1 signaling. Upon interruption of the Dectin-1-Galectin-9 axis, CD4+ and CD8+ T cells—which are dispensable to PDA progression in hosts with an intact signaling axis—became reprogrammed into indispensable mediators of anti-tumor immunity. Without wishing to be bound by theory, blocking Galectin-9-Dectin-1 signaling presents one exemplary mechanism (in addition to TIM-3 and other signaling pathways) that could underlie a strong anti-tumor response a Galectin-9 targeting immunotherapy approach in PDA e.g., by administering an antibody that binds to Galectin-9, such as those described herein.

In some embodiments, the disclosure provides a method for treating pancreatic ductal adenocarcinoma (PDA) in a subject, the method comprising administering to a subject in need thereof an effective amount of an anti-Galectin-9 antibody described herein or antigen binding fragment thereof. In some embodiments, the anti-Galentin-9 antibody is selected from the group consisting of G9.1-1, G9.1-2, G9.1-3, G9.1-4, G9.1-5, G9.1-6, G9.1-7, G9.1-8, G9.1-9, G9.1-10, G9.1-11, G9.1-8m1, G9.1-8m2, G9.1-8m3, G9.1-8m4, G9.1-8m5, G9.1-8m6, G9.1-8m7, G9.1- 8m8, G9.1-8m9, G9.1-8m10, G9.1-8m11, G9.1-8m12, G9.1-8m13, and G9.1-8m14 antibodies, and combinations thereof. In some embodiments, the anti-Galectin-9 antibody is selected from the group consisting of G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, G9.2-26, and G9.2-low affinity binder antibodies, and combinations thereof. Non-limiting examples of such antibodies include for example antibody 9.2-17 or 9.1-8mut13. In any of these methods of treatment, the anti-Galectin-9 antibody is antibody 9.2-17 and/or antibody 9.1-8mut13.

In some embodiments, the disclosure provides the use of an anti-Galectin-9 antibody as a medicament for the treatment of cancer, wherein the anti-Galectin-9 antibody is any of the antibodies described herein in Table 1 and/or Table 2, and wherein the cancer is pancreatic ductal adenocarcinoma (PDA). In some embodiments, the disclosure provides the use of an anti-Galectin-9 antibody as a medicament for the treatment of cancer, wherein the anti-Galectin-9 antibody is antibody 9.1-8m13 and/or 9.2-17, and wherein the cancer is pancreatic ductal adenocarcinoma (PDA). Colorectal cancer (CRC), also known as bowel cancer, colon cancer, or rectal cancer, is any cancer affecting the colon and the rectum. CRC is known to be driven by genetic alterations of tumor cells and is also influenced by tumor-host interactions. Recent reports have demonstrated a direct correlation between the densities of certain T lymphocyte subpopulations and a favorable clinical outcome in CRC, supporting a major role of T-cell-mediated immunity in repressing tumor progression of CRC.

Tim-3, as noted elsewhere herein, is an immune regulatory molecule, which triggers downstream cascade events upon stimulation by galectin-9 (Zhu C, et al. The Tim-3 ligand galectin-9 negatively regulates T helper type 1 immunity; Nature immunology. 2005; 6:1245-1252). Tim-3 has been found to be a critical mediator in CRC progression (Yu et al; Tim-3 is upregulated in human colorectal carcinoma and associated with tumor progression; Mol Med Rep. 2017 February; 15(2): 689-695). In this study, expression of Tim-3 was significantly associated with tumor size (P=0.007), tumor-node-metastasis staging (P<0.0001) and distant metastasis (P<0.0001). Additionally, increased Tim-3 expression is associated with M2 macrophage polarization in colon cancer and promotes tumor growth. Blockade of the Tim-3 pathway inhibited both the polarization of tumor-supporting macrophages and colon cancer growth (Jiang et al., Tim-3 promotes tumor-promoting M2 macrophage polarization by binding to STAT1 and suppressing the STAT1-miR-155 signaling axis; Oncoimmunology, 2016 Aug. 3; 5(9):e1211219). Given these findings and high expression of Galectin-9 observed in colorectal cancers (Lahm et al., J. Cancer Res. Clin. Oncol. 2001; 127:375-386), modulating the Galectin-9/TIM-3 axis by inhibiting the interaction between Galectin-9 and TIM-3, e.g., by administrating an antibody that binds to Galectin-9, is a novel approach to treating such cancers in the clinic which may result in improved outcomes.

In some embodiments, the disclosure provides a method for treating colorectal cancer (CRC) in a subject, the method comprising administering to a subject in need thereof an effective amount of an anti-Galectin-9 antibody described herein or antigen binding fragment thereof. In some embodiments, the anti-Galentin-9 antibody is selected from the group consisting of G9.1-1, G9.1-2, G9.1-3, G9.1-4, G9.1-5, G9.1-6, G9.1-7, G9.1-8, G9.1-9, G9.1-10, G9.1-11, G9.1-8m1, G9.1-8m2, G9.1-8m3, G9.1-8m4, G9.1-8m5, G9.1-8m6, G9.1-8m7, G9.1- 8m8, G9.1-8m9, G9.1-8m10, G9.1-8m11, G9.1-8m12, G9.1-8m13, and G9.1-8m14 antibodies, and combinations thereof. In some embodiments, the anti-Galectin-9 antibody is selected from the group consisting of G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, G9.2-26, and G9.2-low affinity binder antibodies, and combinations thereof. Non-limiting examples of such antibodies include for example antibody 9.2-17 or 9.1-8mut13. In any of these methods of treatment, the anti-Galectin-9 antibody is antibody 9.2-17 and/or antibody 9.1-8mut13.

In some embodiments, the disclosure provides the use of an anti-Galectin-9 antibody as a medicament for the treatment of cancer, wherein the anti-Galectin-9 antibody is any of the antibodies described herein in Table 1 and/or Table 2, and wherein the cancer is colorectal cancer (CRC). In some embodiments, the disclosure provides the use of an anti-Galectin-9 antibody as a medicament for the treatment of cancer, wherein the anti-Galectin-9 antibody is antibody 9.1-8m13 and/or 9.2-17, and wherein the cancer is colorectal cancer (CRC).

Melanoma is the deadliest form of skin cancer and has been increasing in incidence for the past 30 years, especially in young adults. Recent advances have resulted in the development of numerous immune-activating therapies that have greatly improved patient survival.

Accumulation of genetic disorders, most frequently mutations in B-Raf and N-Ras, in the melanocyte are a hallmark of melanoma (Rodriguez-Cerdeira et al., Advances in Immunotherapy for Melanoma: A Comprehensive Review; Mediators Inflamm. 2017; 2017: 3264217, and references therein). However, the interaction between the microenvironment is necessary for these alterations to result in the transformation of a dysplastic melanocyte into a melanoma cell. The microenvironment then also further promotes invasion and metastasis. New therapeutic strategies including CTLA-4, PD-1 and PD-L1/2 blockers, have been developed and have dramatically improved outcomes for melanoma patients (Farkona et al., Cancer immunotherapy: the beginning of the end of cancer? BMC Med. 2016; 14:73). However, these therapies depend on the presence of a functional immune system, which is suppressed in patients with advanced cancer, and new methods to reactivate this suppressed systemic immunity are needed to further improve outcomes for melanoma patients.

In patients with metastatic melanoma, high blood levels of galectin-9 are correlated with worse overall survival and a bias towards a Th2 inflammatory state supportive of tumor growth. Additionally, galectin-9 is co-localized with the M2 macrophage population in metastatic melanoma and soluble forms of galectin-9 in the blood correspond with poor survival (Enninga et al., Melanoma Res. 2016 October; 26(5):429-41). Association of Galectin-9 with M2 macrophages was found to be due to Galectin-9 ligation to CD206 on M2 macrophages, which resulted in pro-tumor phenotype in the local microenvironment. Accordingly, both Galectin-9/dectin-1 and Galectin-9/CD206 interactions may promote macrophage mediated immune suppressive effects. Without wishing to be bound by theory, these findings indicate that inhibiting Galectin-9/dectin-1 and Galectin-9/CD206 interactions, e.g., by administering an antibody that binds to Galectin-9, may present a rationale for employing anti-Galectin-9 antibodies in a therapeutic approach in melanoma, which will lead to improved overall survival, in patients, including but not limited to those refractory to anti-CTLA-4, PD-1 and PD-L1/2 therapies.

In some embodiments, the disclosure provides a method for treating melanoma in a subject, the method comprising administering to a subject in need thereof an effective amount of an anti-Galectin-9 antibody described herein or antigen binding fragment thereof. In some embodiments, the anti-Galentin-9 antibody is selected from the group consisting of G9.1-1, G9.1-2, G9.1-3, G9.1-4, G9.1-5, G9.1-6, G9.1-7, G9.1-8, G9.1-9, G9.1-10, G9.1-11, G9.1-8m1, G9.1-8m2, G9.1-8m3, G9.1-8m4, G9.1-8m5, G9.1-8m6, G9.1-8m7, G9.1-8m8, G9.1-8m9, G9.1-8m10, G9.1-8m11, G9.1-8m12, G9.1-8m13, and G9.1-8m14 antibodies, and combinations thereof. In some embodiments, the anti-Galectin-9 antibody is selected from the group consisting of G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, G9.2-26, and G9.2-low affinity binder antibodies, and combinations thereof. Non-limiting examples of such antibodies include for example antibody 9.2-17 or 9.1-8mut13. In any of these methods of treatment, the anti-Galectin-9 antibody is antibody 9.2-17 and/or antibody 9.1-8mut13.

In some embodiments, the disclosure provides the use of an anti-Galectin-9 antibody as a medicament for the treatment of cancer, wherein the anti-Galectin-9 antibody is any of the antibodies described herein in Table 1 and/or Table 2, and wherein the cancer is melanoma. In some embodiments, the disclosure provides the use of an anti-Galectin-9 antibody as a medicament for the treatment of cancer, wherein the anti-Galectin-9 antibody is antibody 9.1-8m13 and/or 9.2-17, and wherein the cancer is melanoma.

Cholangiocarcinoma (CCA) is an epithelial cancer that forms in the bile ducts and is the most common biliary malignancy and the second most common hepatic malignancy after hepatocellular carcinoma and the overall incidence of cholangiocarcinoma has increased progressively worldwide over the past four decades. CCAs are classified into three subtypes based on their anatomic location, intrahepatic cholangiocarcinoma (iCCA), perihilar CCA (pCCA), and distal CCA (dCCA) (see, e.g., Loeuillard et al., Animal models of cholangiocarcinoma; Biochim Biophys Acta Mol Basis Dis. 2018 Apr. 5, and Rizvi et al., Cholangiocarcinoma—evolving concepts and therapeutic strategies; Nat Rev Clin Oncol. 2018 February; 15(2): 95-111).

In a restrospective immune profiling study in of 99 surgically resected iHCC, TIM-3-positive staining of centrally located, tumor infiltrative lymphocytes was observed, at levels 3 times greater than PD-1 staining. Overall survival was significantly associated with lower numbers of TIM-3 tumor infiltrating lymphocytes (ascopubs.org/doi/abs/10.1200/JC0.2018.36.15_suppl.12049). Accordingly, reducing TIM-3 activity or signaling, e.g., by inhibiting the Gal-9/Tim-3 interaction in an immunotherapeutic approach, e.g., by administering an anti-Galectin-9 antibody such as one or more of the anti-Galectin-9 antibodies described herein, may have a positive impact on overall survival.

In some embodiments, the disclosure provides a method for treating cholangiocarcinoma in a subject, the method comprising administering to a subject in need thereof an effective amount of an anti-Galectin-9 antibody described herein or antigen binding fragment thereof. In some embodiments, the anti-Galentin-9 antibody is selected from the group consisting of G9.1-1, G9.1-2, G9.1-3, G9.1-4, G9.1-5, G9.1-6, G9.1-7, G9.1-8, G9.1-9, G9.1-10, G9.1-11, G9.1-8m1, G9.1-8m2, G9.1-8m3, G9.1-8m4, G9.1-8m5, G9.1-8m6, G9.1-8m7, G9.1-8m8, G9.1-8m9, G9.1-8m10, G9.1-8m11, G9.1-8m12, G9.1-8m13, and G9.1-8m14 antibodies, and combinations thereof. In some embodiments, the anti-Galectin-9 antibody is selected from the group consisting of G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, G9.2-26, and G9.2-low affinity binder antibodies, and combinations thereof. Non-limiting examples of such antibodies include for example antibody 9.2-17 or 9.1-8mut13. In any of these methods of treatment, the anti-Galectin-9 antibody is antibody 9.2-17 and/or antibody 9.1-8mut13.

In some embodiments, the disclosure provides the use of an anti-Galectin-9 antibody as a medicament for the treatment of cancer, wherein the anti-Galectin-9 antibody is any of the antibodies described herein in Table 1 and/or Table 2, and wherein the cancer is cholangiocarcinoma. In some embodiments, the disclosure provides the use of an anti-Galectin-9 antibody as a medicament for the treatment of cancer, wherein the anti-Galectin-9 antibody is antibody 9.1-8m13 and/or 9.2-17, and wherein the cancer is cholangiocarcinoma.

Renal Cell Carcinoma (RCC) has the highest mortality rate of the genitourinary cancers and the incidence of RCC has risen steadily, while the outcome remains poor. Approximately 273,000 new cases of kidney cancer are diagnosed worldwide each year. About one third of patients with localized disease will suffer recurrence or metastasis. Once metastasis occurs, malignancy metastasize, the 5-year survival for patients is less than 10%. Clear-cell renal cell carcinoma (ccRCC) is the major histological subtype, which accounts for 80-90% of all the RCCs. RCC is sensitive to immunotherapy and targeted therapy while highly resistant to both chemotherapy and radiation therapy.

In RCC patients, Gal-9 is expressed at much higher levels in cancerous lesions than the surrounding normal tissue, and patients with high Galectin-9 expression showed more advanced progression of the disease with larger tumor size and necrosis (Kawashima et al.; BJU Int. 2014; 113:320-332). Gal-9 in tumor tissue of ccRCC patients was significantly positively associated with tumor size, Fuhrman grade, necrosis, and impaired clinical outcome including poor survival and early recurrence (Fu et al., Galectin-9 predicts postoperative recurrence and survival of patients with clear-cell renal cell carcinoma; Tumour Biol. 2015 August; 36(8): 5791-9). TIM-3 is also associated with poor prognosis in RCC, and knockdown of TIM-3 suppresses the proliferation and invasion capacity of ccRCC cell lines (Yuan et al., Prognostic implication of Tim-3 in clear cell renal cell carcinoma. Neoplasma. 2014; 61:35-40). Accordingly, the Gal-9/TIM-3 axis might play an important role in the development of renal cell carcinoma and administration of immunotherapeutic agents which inhibit Gal-9 binding to TIM-3, such as the anti-Galectin-9 antibodies described herein, e.g., in Table 1 and/or Table 2, may result in increased survival and lower reoccurrence in RCC.

In some embodiments, the disclosure provides a method for treating renal cancer in a subject, the method comprising administering to a subject in need thereof an effective amount of an anti-Galectin-9 antibody described herein or antigen binding fragment thereof. In some embodiments, the anti-Galentin-9 antibody is selected from the group consisting of G9.1-1, G9.1-2, G9.1-3, G9.1-4, G9.1-5, G9.1-6, G9.1-7, G9.1-8, G9.1-9, G9.1-10, G9.1-11, G9.1-8m1, G9.1-8m2, G9.1-8m3, G9.1-8m4, G9.1-8m5, G9.1-8m6, G9.1-8m7, G9.1-8m8, G9.1-8m9, G9.1-8m10, G9.1-8m11, G9.1-8m12, G9.1-8m13, and G9.1-8m14 antibodies, and combinations thereof. In some embodiments, the anti-Galectin-9 antibody is selected from the group consisting of G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, G9.2-26, and G9.2-low affinity binder antibodies, and combinations thereof. Non-limiting examples of such antibodies include for example antibody 9.2-17 or antibody 9.1-8mut13. In any of these methods of treatment, the anti-Galectin-9 antibody is antibody 9.2-17 and/or antibody 9.1-8mut13.

In some embodiments, the disclosure provides the use of an anti-Galectin-9 antibody as a medicament for the treatment of cancer, wherein the anti-Galectin-9 antibody is any of the antibodies described herein in Table 1 and/or Table 2, and wherein the cancer is renal cell carcinoma (RCC). In some embodiments, the disclosure provides the use of an anti-Galectin-9 antibody as a medicament for the treatment of cancer, wherein the anti-Galectin-9 antibody is antibody 9.1-8m13 and/or 9.2-17, and wherein the cancer is renal cell carcinoma (RCC).

Hepatocellular carcinoma (HCC) is the most common type of primary liver cancer. Hepatocellular carcinoma occurs most often in people with chronic liver diseases, such as cirrhosis caused by hepatitis B or hepatitis C infection. HCC is usually accompanied by cirrhotic liver with extensive lymphocyte infiltration due to chronic viral infection. Many studies have demonstrated that tumor-infiltrating effector CD8+ T cells and T helper 17 (Th17) cells correlate with improved survival after surgical resection of tumors. However, tumor-infiltrating effector T cells fail to control tumor growth and metastasis Pang et al., The immunosuppressive tumor microenvironment in hepatocellular carcinoma; Cancer Immunol Immunother 2009; 58:877-886).

The TIM-3/galectin-9 interaction contributes to immune dysfunction in human HCC (Li, et al., Tim-3/galectin-9 signaling pathway mediates T-cell dysfunction and predicts poor prognosis in patients with hepatitis B virus-associated hepatocellular carcinoma; Hepatology. 2012 October; 56(4): 1342-51). High Galectin-9 expression is found on myeloid APCs and high numbers of Tim-3+ T cells are found in HBV-associated HCC, and blocking Tim-3/galectin-9 signaling using TIM-3 antibodies recovers effector T-cell function in T cells isolated from human HCC. Thus, the targeting Tim-3/Galectin-9 axis, e.g., by administering anti-Galectin-9 antibodies, e.g., such as anti-Galectin-9 antibodies shown in Table 1 and Table 2 herein, including, but not limited to, antibody 9.1-8mut13 and/or antibody 9.2-17, constitutes a novel immune therapeutic strategy for treating patients with HBV-associated HCC.

In some embodiments, the disclosure provides a method for treating hepatocellular carcinoma in a subject, the method comprising administering to a subject in need thereof an effective amount of an anti-Galectin-9 antibody described herein or antigen binding fragment thereof. In some embodiments, the anti-Galentin-9 antibody is selected from the group consisting of G9.1-1, G9.1-2, G9.1-3, G9.1-4, G9.1-5, G9.1-6, G9.1-7, G9.1-8, G9.1-9, G9.1-10, G9.1-11, G9.1-8m1, G9.1-8m2, G9.1-8m3, G9.1-8m4, G9.1-8m5, G9.1-8m6, G9.1-8m7, G9.1- 8m8, G9.1-8m9, G9.1-8m10, G9.1-8m11, G9.1-8m12, G9.1-8m13, and G9.1-8m14 antibodies, and combinations thereof. In some embodiments, the anti-Galectin-9 antibody is selected from the group consisting of G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, G9.2-26, and G9.2-low affinity binder antibodies, and combinations thereof. Non-limiting examples of such antibodies include for example antibody 9.2-17 or 9.1-8mut13. In any of these methods of treatment, the anti-Galectin-9 antibody is antibody 9.2-17 and/or antibody 9.1-8mut13. Acute myeloid leukemia (AML) is the most common form of acute leukemia, with an incidence that increases with advanced age. Commonly of unknown etiology, AML can also occur as a result of exposure to genotoxic agents or following a previous hematologic disorder. AML is complex, with genetic, epigenetic, and phenotypic heterogeneity (Lowenberg and Rowe, Introduction to the review series on advances in acute myeloid leukemia (AML); Blood 2016 127:1).

In some embodiments, the disclosure provides the use of an anti-Galectin-9 antibody as a medicament for the treatment of cancer, wherein the anti-Galectin-9 antibody is any of the antibodies described herein in Table 1 and/or Table 2, and wherein the cancer is hepatocellular carcinoma (HCC). In some embodiments, the disclosure provides the use of an anti-Galectin-9 antibody as a medicament for the treatment of cancer, wherein the anti-Galectin-9 antibody is antibody 9.1-8m13 and/or 9.2-17, and wherein the cancer is hepatocellular carcinoma (HCC).

Recent studies suggest that the TIM-3/Gal-9 axis that TIM-3 and Gal-9 are connected to the establishment of AML. Malignant stem cells achieve dominant clonal selection through acquisition of multiple genetic abnormalities. These genetic abnormalities progressively accumulate in self-renewing hematopoietic stem cells (HSCs), and, as a consequence, these genetically impaired preleukemic HSCs transform into leukemic stem cells (LSCs). As part of this process, preleukemic HSCs outgrow normal HSCs, and finally self-renew at a hematopoietic progenitor cell stage to become myeloid LSCs (Walter et al., Clonal architecture of secondary acute myeloid leukemia; N. Engl. J. Med., 366 (2012), pp. 1090-1098). Kikshige et al., (Kikushige et al., A TIM-3/Gal-9 Autocrine Stimulatory Loop Drives Self-Renewal of Human Myeloid Leukemia Stem Cells and Leukemic Progression (Cell Stem Cell 17; 3(2015), 341-352) observed that serum Galectin-9 levels were significantly elevated in AML patients and that the Tim3/Gal-9 axis stimulates an autocrine loop which functions to allow clonal dominancy and self-renewal of LSCs. Gal-9-mediated TIM-3 stimulation lead to the induction of LSC self renewal pathways. Of note, since significant upregulation of TIM-3 in HSC and HPC populations, as well as elevation of serum Gal-9, was observed in patients with preleukemic myeloid disorders, acquisition of Galectin-9 secretion likely occurs early during leukemia progression. Accordingly, targeting the Gal-9/TIM-3 axis, e.g., through the administration of an anti-Galectin-9 antibody, such as one or more of the anti-Galectin-9 antibodies described herein, e.g., in Table 1 and/or Table 2, including antibody 9.1-8mut13 and/or antibody 9.2-17, may constitute a novel approach to cancer stem cell therapy common to human myeloid malignancies, and moreover, such therapies may be useful not only to eradicate LSCs in AMLs, but also to prevent progression of preleukemic disorders into overt AML. Such preleukemic disorders include the refractory cytopenia with multilineage displasia (RCMD) stage in myelodysplastic syndromes (MDS) or the chronic phase of myeloproliferative neoplasms (MPN), including chronic myelogenous leukemia.

In some embodiments, the disclosure provides a method for treating a hematological malignancy in a subject, the method comprising administering to a subject in need thereof an effective amount of an anti-Galectin-9 antibody described herein or antigen binding fragment thereof. In some embodiments, the disclosure provides a method for treating acute lymphoblastic leukemia in a subject, the method comprising administering to a subject in need thereof an effective amount of an anti-Galectin-9 antibody described herein or antigen binding fragment thereof. In some embodiments, the disclosure provides a method for treating acute myeloid leukemia in a subject, the method comprising administering to a subject in need thereof an effective amount of an anti-Galectin-9 antibody described herein or antigen binding fragment thereof.

In some embodiments, the disclosure provides a method for preventing progression of preleukemic disorders into acute myeloid leukemia in a subject, the method comprising administering to a subject in need thereof an effective amount of an anti-Galectin-9 antibody described herein or antigen binding fragment thereof. In some embodiments, the preleukemic disorders comprise RCMD stage in MDS or the chronic phase of MPN, including chronic myelogenous leukemia. In some embodiments, the anti-Galentin-9 antibody is selected from the group consisting of G9.1-1, G9.1-2, G9.1-3, G9.1-4, G9.1-5, G9.1-6, G9.1-7, G9.1-8, G9.1-9, G9.1-10, G9.1-11, G9.1-8m1, G9.1-8m2, G9.1-8m3, G9.1-8m4, G9.1-8m5, G9.1-8m6, G9.1-8m7, G9.1-8m8, G9.1-8m9, G9.1-8m10, G9.1-8m11, G9.1-8m12, G9.1-8m13, and G9.1-8m14 antibodies, and combinations thereof. In some embodiments, the anti-Galectin-9 antibody is selected from the group consisting of G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, G9.2-26, and G9.2-low affinity binder antibodies, and combinations thereof. Non-limiting examples of such antibodies include for example antibody 9.2-17 or 9.1-8mut13. In any of these methods of treatment, the anti-Galectin-9 antibody is antibody 9.2-17 and/or antibody 9.1-8mut13.

In some embodiments, the disclosure provides the use of an anti-Galectin-9 antibody as a medicament for the treatment of cancer, wherein the anti-Galectin-9 antibody is any of the antibodies described herein in Table 1 and/or Table 2, and wherein the cancer is a hematological malignancy. In some embodiments, the disclosure provides the use of an anti-Galectin-9 antibody as a medicament for the treatment of cancer, wherein the anti-Galectin-9 antibody is antibody 9.1-8m13 and/or 9.2-17, and wherein the cancer is hematological malignancy.

In some embodiments, the disclosure provides the use of an anti-Galectin-9 antibody as a medicament for the treatment of cancer, wherein the anti-Galectin-9 antibody is any of the antibodies described herein in Table 1 and/or Table 2, and wherein the cancer is AML. In some embodiments, the disclosure provides the use of an anti-Galectin-9 antibody as a medicament for the treatment of cancer, wherein the anti-Galectin-9 antibody is antibody 9.1-8m13 and/or 9.2-17, and wherein the cancer is AML.

In some embodiments, the disclosure provides the use of an anti-Galectin-9 antibody as a medicament for the treatment of cancer, wherein the anti-Galectin-9 antibody is any of the antibodies described herein in Table 1 and/or Table 2, and wherein the cancer is ALL. In some embodiments, the disclosure provides the use of an anti-Galectin-9 antibody as a medicament for the treatment of cancer, wherein the anti-Galectin-9 antibody is antibody 9.1-8m13 and/or 9.2-17, and wherein the cancer is ALL. In any of the above-described methods, the treatment method further comprises administering to the subject an inhibitor of a checkpoint molecule, an activator of a co-stimulatory receptor, and/or an inhibitor of an innate immune cell target. In some embodiments, the treatment method further comprises administering to the subject an inhibitor of a checkpoint molecule. In some embodiments, the checkpoint molecule is selected from the group consisting of PD-1, PD-L1, PD-L2, CTLA-4, LAG3, TIM-3 and A2aR. In some embodiments, the treatment method further comprises administering to the subject an inhibitor of an activator of a co-stimulatory receptor, and/or an inhibitor of an innate immune cell target. In some embodiments, the co-stimulatory receptor is selected from the group consisting of OX40, GITR, CD137, CD40, CD27, and ICOS. In some embodiments, the treatment method further comprises administering to the subject an inhibitor of an innate immune cell target. In some embodiments, the innate immune cell target is selected from the group consisting of KIR, NKG2A, CD96, TLR, and IDO. In some embodiments, the anti-Galectin-9 antibody is selected from the group consisting of G9.1-1, G9.1-2, G9.1-3, G9.1-4, G9.1-5, G9.1-6, G9.1-7, G9.1-8, G9.1-9, G9.1-10, G9.1-11, G9.1-8m1, G9.1-8m2, G9.1-8m3, G9.1-8m4, G9.1-8m5, G9.1-8m6, G9.1-8m7, G9.1-8m8, G9.1-8m9, G9.1-8m10, G9.1-8m11, G9.1-8m12, G9.1-8m13, and G9.1-8m14 antibodies, and combinations thereof. In some embodiments, the anti-Galectin-9 antibody is selected from the group consisting of G9.2-1, G9.2-2, G9.2-3, G9.2-4, G9.2-5, G9.2-6, G9.2-7, G9.2-8, G9.2-9, G9.2-10, G9.2-11, G9.2-12, G9.2-13, G9.2-14, G9.2-15, G9.2-16, G9.2-17, G9.2-17mut6, G9.2-18, G9.2-19, G9.2-20, G9.2-21, G9.2-22, G9.2-23, G9.2-24, G9.2-25, G9.2-26, and G9.2-low affinity binder antibodies, and combinations thereof. Non-limiting examples of such antibodies include for example antibody 9.2-17 or 9.1-8mut13. In any of these methods of treatment, the anti-Galectin-9 antibody is antibody 9.2-17 and/or antibody 9.1-8mut13. In some embodiments, the cancer is selected from pancreatic cancer, e.g., pancreatic ductal adenocarcinoma, cholangiocarcinoma, hepatocellular carcinoma, colorectal cancer, melanoma, renal cell carcinoma, and acute myeloid leukemia.

In some embodiments, the disclosure provides the use of an anti-Galectin-9 antibody as a medicament for the treatment of cancer in combination with a checkpoint inhibitor molecule, e.g., wherein the checkpoint inhibitor molecule is selected from the group consisting of PD-1, PD-L1, PD-L2, CTLA-4, LAG3, TIM-3 and A2aR, wherein the anti-Galectin-9 antibody is any of the antibodies described herein in Table 1 and/or Table 2. In some embodiments, the disclosure provides the use of an anti-Galectin-9 antibody as a medicament for the treatment of cancer in combination with a checkpoint molecule, wherein the checkpoint inhibitor molecule is selected from the group consisting of PD-1, PD-L1, PD-L2, CTLA-4, LAG3, TIM-3 and A2aR, and wherein the anti-Galectin-9 antibody is antibody 9.1-8m13 and/or 9.2-17.

In some embodiments, the disclosure provides the use of an anti-Galectin-9 antibody as a medicament for the treatment of cancer in combination with a co-stimulatory molecule, e.g., wherein the co-stimulatory molecule is selected from the group consisting of OX40, GITR, CD137, CD40, CD27, and ICOS, and wherein the anti-Galectin-9 antibody is any of the antibodies described herein in Table 1 and/or Table 2. In some embodiments, the disclosure provides the use of an anti-Galectin-9 antibody as a medicament for the treatment of cancer in combination with a co-stimulatory, wherein the co-stimulatory molecule is selected from the group consisting of OX40, GITR, CD137, CD40, CD27, and ICOS, wherein the anti-Galectin-9 antibody is antibody 9.1-8m13 and/or 9.2-17. In some embodiments, the methods of the present disclosure may increase anti-tumor activity (e.g., reduce cell proliferation, tumor growth, tumor volume, and/or tumor burden or load or reduce the number of metastatic lesions over time) by at least about 10%, 20%, 25%, 30%, 40%, 50%, 60%, 70%, 75%, 80%, 85%, 90%, 95%, or more as compared to levels prior to treatment or in a control subject. In some embodiments, reduction is measured by comparing cell proliferation, tumor growth, and/or tumor volume in a subject before and after administration of the pharmaceutical composition. In some embodiments, the method of treating or ameliorating a cancer in a subject allows one or more symptoms of the cancer to improve by at least about 10%, 20%, 30%, 40%, 50%, 60%, 70%, 80%, 90%, 95%, or more. Before, during, and after the administration of the pharmaceutical composition, cancerous cells and/or biomarkers in a subject may be measured in a biological sample, such as blood, serum, plasma, urine, peritoneal fluid, and/or a biopsy from a tissue or organ. In some embodiments, the methods may include administration of the compositions of the invention to reduce tumor volume, size, load or burden in a subject to an undetectable size, or to less than about 1%, 2%, 5%, 10%, 20%, 25%, 30%, 40%, 50%, 60%, 70%, 75%, 80%, or 90% of the subject's tumor volume, size, load or burden prior to treatment. In other embodiments, the methods may include administration of the compositions of the invention to reduce the cell proliferation rate or tumor growth rate in a subject to an undetectable rate, or to less than about 1%, 2%, 5%, 10%, 20%, 25%, 30%, 40%, 50%, 60%, 70%, 75%, 80%, or 90% of the rate prior to treatment. In other embodiments, the methods may include administration of the compositions of the invention to reduce the development of or the number or size of metastatic lesions in a subject to an undetectable rate, or to less than about 1%, 2%, 5%, 10%, 20%, 25%, 30%, 40%, 50%, 60%, 70%, 75%, 80%, or 90% of the rate prior to treatment.

In some embodiments, compositions are provided comprising one or more anti-Galectin-9 antibodies, which may be used to treat, manage, ameliorate, and/or prevent cancer. In some embodiments, compositions of the disclosure comprise two or more anti-Galectin-9 antibodies, alone or in combination with prophylactic agents, therapeutic agents (e.g., chemotherapy or immunotherapy), and/or pharmaceutically acceptable carriers and the use thereof are provided. In some embodiments, the one or more antibodies bind to CRD1. In some embodiments, the one or more antibodies bind to CRD2. In some embodiments, the one or more antibodies bind to CRD1. In some embodiments, the compositions can comprise a combinattion of antibodies, some of which bind to CRD1, and some of which bind to CRD2. A non-limiting example of a combination is a combination comprising 9.2-17 and 9.1-8mut1. Antibodies can be combined in equimolar or non-equimolar amounts.

Pharmaceutical Compositions

The anti-Galectin-9 antibodies, as well as the encoding nucleic acids or nucleic acid sets, vectors comprising such, or host cells comprising the vectors, as described herein can be mixed with a pharmaceutically acceptable carrier (excipient) to form a pharmaceutical composition for use in treating a target disease. "Acceptable" means that the carrier must be compatible with the active ingredient of the composition (and preferably, capable of stabilizing the active ingredient) and not deleterious to the subject to be treated. Pharmaceutically acceptable excipients (carriers) including buffers, which are well known in the art. See, e.g., Remington: The Science and Practice of Pharmacy 20th Ed. (2000) Lippincott Williams and Wilkins, Ed. K. E. Hoover.

The pharmaceutical compositions to be used in the present methods can comprise pharmaceutically acceptable carriers, excipients, or stabilizers in the form of lyophilized formulations or aqueous solutions. (Remington: The Science and Practice of Pharmacy 20th Ed. (2000) Lippincott Williams and Wilkins, Ed. K. E. Hoover). Acceptable carriers, excipients, or stabilizers are nontoxic to recipients at the dosages and concentrations used, and may comprise buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrans; chelating agents such as EDTA; sugars such as sucrose, mannitol, trehalose or sorbitol; salt-forming counter-ions such as sodium; metal complexes (e.g. Zn-protein complexes); and/or non-ionic surfactants such as TWEEN', PLURONICS' or polyethylene glycol (PEG). In some examples, the pharmaceutical composition described herein comprises liposomes containing the antibodies (or the encoding nucleic acids) which can be prepared by methods known in the art, such as described in Epstein, et al., Proc. Natl. Acad. Sci. USA 82:3688 (1985); Hwang, et al., Proc. Natl. Acad. Sci. USA 77:4030 (1980); and U.S. Pat. Nos. 4,485,045 and 4,544,545. Liposomes with enhanced circulation time are disclosed in U.S. Pat. No. 5,013,556. Particularly useful liposomes can be generated by the reverse phase evaporation method with a lipid composition comprising phosphatidylcholine, cholesterol and PEG-derivatized phosphatidylethanolamine (PEG-PE). Liposomes are extruded through filters of defined pore size to yield liposomes with the desired diameter.

The anti-Galectin-9 antibodies, or the encoding nucleic acid(s), may also be entrapped in microcapsules prepared, for example, by coacervation techniques or by interfacial polymerization, for example, hydroxymethylcellulose or gelatin-microcapsules and poly-(methylmethacylate) microcapsules, respectively, in colloidal drug delivery systems (for example, liposomes, albumin microspheres, microemulsions, nano-particles and nanocapsules) or in macroemulsions. Such techniques are known in the art, see, e.g., Remington, The Science and Practice of Pharmacy 20th Ed. Mack Publishing (2000).

In other examples, the pharmaceutical composition described herein can be formulated in sustained-release format. Suitable examples of sustained-release preparations include semipermeable matrices of solid hydrophobic polymers containing the antibody, which matrices are in the form of shaped articles, e.g. films, or microcapsules. Examples of sustained-release matrices include polyesters, hydrogels (for example, poly(2-hydroxyethyl-methacrylate), or poly(vinyl alcohol)), polylactides (U.S. Pat. No. 3,773,919), copolymers of L-glutamic acid and 7 ethyl-L-glutamate, non-degradable ethylene-vinyl acetate, degradable lactic acid-glycolic acid copolymers such as the LUPRON DEPOT' (injectable microspheres composed of lactic acid-glycolic acid copolymer and leuprolide acetate), sucrose acetate isobutyrate, and poly-D-(-)-3-hydroxybutyric acid.

The pharmaceutical compositions to be used for in vivo administration must be sterile. This is readily accomplished by, for example, filtration through sterile filtration membranes. Therapeutic antibody compositions are generally placed into a container having a sterile access port, for example, an intravenous solution bag or vial having a stopper pierceable by a hypodermic injection needle.

The pharmaceutical compositions described herein can be in unit dosage forms such as tablets, pills, capsules, powders, granules, solutions or suspensions, or suppositories, for oral, parenteral or rectal administration, or administration by inhalation or insufflation.

For preparing solid compositions such as tablets, the principal active ingredient can be mixed with a pharmaceutical carrier, e.g., conventional tableting ingredients such as corn starch, lactose, sucrose, sorbitol, talc, stearic acid, magnesium stearate, dicalcium phosphate or gums, and other pharmaceutical diluents, e.g., water, to form a solid preformulation composition containing a homogeneous mixture of a compound of the present invention, or a non-toxic pharmaceutically acceptable salt thereof. When referring to these preformulation compositions as homogeneous, it is meant that the active ingredient is dispersed evenly throughout the composition so that the composition may be readily subdivided into equally effective unit dosage forms such as tablets, pills and capsules. This solid preformulation composition is then subdivided into unit dosage forms of the type described above containing from 0.1 to about 500 mg of the active ingredient of the present invention. The tablets or pills of the novel composition can be coated or otherwise compounded to provide a dosage form affording the advantage of prolonged action. For example, the tablet or pill can comprise an inner dosage and an outer dosage component, the latter being in the form of an envelope over the former. The two components can be separated by an enteric layer that serves to resist disintegration in the stomach and permits the inner component to pass intact into the duodenum or to be delayed in release. A variety of materials can be used for such enteric layers or coatings, such materials including a number of polymeric acids and mixtures of polymeric acids with such materials as shellac, cetyl alcohol and cellulose acetate. Suitable surface-active agents include, in particular, non-ionic agents, such as polyoxyethylenesorbitans (e.g., Tween™ 20, 40, 60, 80 or 85) and other sorbitans (e.g., Span™ 20, 40, 60, 80 or 85). Compositions with a surface-active agent will conveniently comprise between 0.05 and 5% surface-active agent, and can be between 0.1 and 2.5%. It will be appreciated that other ingredients may be added, for example mannitol or other pharmaceutically acceptable vehicles, if necessary.

Suitable emulsions may be prepared using commercially available fat emulsions, such as Intralipid™, Liposyn™, Infonutrol™, Lipofundin™ and Lipiphysan™. The active ingredient may be either dissolved in a pre-mixed emulsion composition or alternatively it may be dissolved in an oil (e.g., soybean oil, safflower oil, cottonseed oil, sesame oil, corn oil or almond oil) and an emulsion formed upon mixing with a phospholipid (e.g. egg phospholipids, soybean phospholipids or soybean lecithin) and water. It will be appreciated that other ingredients may be added, for example glycerol or glucose, to adjust the tonicity of the emulsion. Suitable emulsions will typically contain up to 20% oil, for example, between 5 and 20%. The fat emulsion can comprise fat droplets between 0.1 and 1.0 .im, particularly 0.1 and 0.5 .im, and have a pH in the range of 5.5 to 8.0.

The emulsion compositions can be those prepared by mixing an antibody with Intralipid™ or the components thereof (soybean oil, egg phospholipids, glycerol and water).

Pharmaceutical compositions for inhalation or insufflation include solutions and suspensions in pharmaceutically acceptable, aqueous or organic solvents, or mixtures thereof, and powders. The liquid or solid compositions may contain suitable pharmaceutically acceptable excipients as set out above. In some embodiments, the compositions are administered by the oral or nasal respiratory route for local or systemic effect.

Compositions in preferably sterile pharmaceutically acceptable solvents may be nebulized by use of gases. Nebulized solutions may be breathed directly from the nebulizing device or the nebulizing device may be attached to a face mask, tent or intermittent positive pressure breathing machine. Solution, suspension or powder compositions may be administered, preferably orally or nasally, from devices which deliver the formulation in an appropriate manner.

Therapeutic Applications

The present disclosure provides methods of eliminating pathologic cells expressing Galectin-9, the method comprising administering to a subject having pathologic cells expressing Galectin-9 an effective amount of a pharmaceutical composition comprising an anti-Galectin-9 antibody described herein. The present disclosure also provides methods of inhibiting Galectin-9-mediated cell signaling in a subject, the method comprising administering to a subject in need thereof an effective amount of a pharmaceutical composition comprising an anti-Galectin-9 antibody described herein.

To practice the methods disclosed herein, an effective amount of the pharmaceutical composition described herein can be administered to a subject (e.g., a human) in need of the treatment via a suitable route, systemically or locally. In some embodiments, the anti-Galectin-9 antibodies are administered by intravenous administration, e.g., as a bolus or by continuous infusion over a period of time, by intramuscular, intraperitoneal, intracerebrospinal, subcutaneous, intra-arterial, intra-articular, intrasynovial, intrathecal, intratumoral, oral, inhalation or topical routes. Commercially available nebulizers for liquid formulations, including jet nebulizers and ultrasonic nebulizers are useful for administration. Liquid formulations can be directly nebulized and lyophilized powder can be nebulized after reconstitution. Alternatively, the antibodies as described herein can be aerosolized using a fluorocarbon formulation and a metered dose inhaler, or inhaled as a lyophilized and milled powder.

The subject to be treated by the methods described herein can be a mammal, more preferably a human. Mammals include, but are not limited to, farm animals, sport animals, pets, primates, horses, dogs, cats, mice and rats. A human subject who needs the treatment may be a human patient having, at risk for, or suspected of having a target disease/disorder, such as a solid tumor, hematological malignancy, autoimmune disease (such as an allergic disorder), microbial disease, and fibrotic condition.

Examples of solid tumor cancers include pancreatic duct adenocarcinoma (PDA), colorectal cancer (CRC), melanoma, cholangiocarcinoma, breast cancer, lung cancer (for example, non-small cell lung cancer, NSCLC, and small cell lung cancer, SCLC), upper and lower gastrointestinal malignancies (including, but not limited to, esophageal, gastric, and hepatobiliary cancer), squamous cell head and neck cancer, genitourinary cancers, ovarian cancer, and sarcomas. Hematological malignancies include acute lymphoblastic leukemia, chronic lymphocytic leukemia, lymphomas, multiple myeloma, acute myelogenous leukemia, chronic myelogenous leukemia, myelodysplastic syndromes and the myeloproliferative neoplasms, such as essential thrombocythemia, polycythemia vera and myelofibrosis. A subject having a solid tumor or a hematological malignancy can be identified by routine medical examination, e.g., laboratory tests, organ functional tests, CT scans, or ultrasounds. In some embodiments, the subject to be treated by the method described herein may be a human cancer patient who has undergone or is subjecting to an anti-cancer therapy, for example, chemotherapy, radiotherapy, immunotherapy, or surgery.

Examples of autoimmune diseases include rheumatoid conditions, metabolic and endocrine conditions, as well as respiratory and allergic conditions. A subject having an autoimmune disease can be identified by routine medical examination, e.g., with laboratory tests, such as antinuclear antibodies, anti-mitochondrial autoantibodies, anti-neutrophil cytoplasmic antibody, anti-phospholipid antibodies, anti-citrullinated peptide (anti-CCP), anti-rheumatoid factor, immunoglobulin A, C-reactive protein test, complement test, erythrocyte sedimentation rate (ESR) test, blood clotting profie, and protein electrophoresis/immunofixation electrophoresis, among others. In some embodiments, the subject to be treated by the method described herein may be a human subject with an autoimmune disease who has undergone or is subjecting to an autoimmune disease treatment, for example, immunosuppressive mediation, hormone replacement therapy, blood transfusions, anti-inflammatory medication, and/or pain medication.

Microbial diseases can be caused by a variety of pathogens, including bacteria, fungi, protozoa and viruses. Exemplary infectious bacteria include *Streptococcus pyogenes, Streptococcus pneumoniae, Neisseria gonorrheae, Neisseria meningitidis, Corynebacterium diphtherias, Clostridium botulinum, Clostridium perfringens, Clostridium tetani, Hemophilus influenzae, Klebsiella pneumoniae, Klebsiella ozaenas, Klebsiella rhinoscleromotis, Staphylococcus aureus, Vibrio colerae, Escherichia coli, Pseudomonas aeruginosa, Campylobacter (Vibrio) fetus, Aeromonas hydrophila, Bacillus aureus, Edwardsiella tarda, Yersinia enterocolitica, Yersinia pestis, Yersinia pseudotuberculosis, Shigella dysenteriae, Shigella flexneri, Shigella sonnei, Salmonella typhimurium, Treponema pallidum, Treponema pertenue, Treponema carateneum, Borrelia vincentii, Borrelia burgdorferi, Leptospira icterohemorrhagiae, Mycobacterium tuberculosis, Pneumocystis carinii, Francisella tularensis, Brucella abortus, Brucella suis, Brucella melitensis, Mycoplasma* spp., *Rickettsia prowazeki, Rickettsia tsutsugumushi*, and *Chlamydia* spp. Examples of pathologic fungi include *Coccidioides immitis, Aspergillusfumigatus, Candida albicans, Blastomyces dermatitidis, Cryptococcus neoformans*, and *Histoplasma capsulatum*. Pathologic protozoa include *Entomoeba histolytica, Toxoplasma gondii, Trichomonas tenas, Trichomonas hominis, Trichomonas vaginalis, Tryoanosoma gambiense, Trypanosoma rhodesiense, Trypanosoma cruzi, Leishmania donovani, Leishmania tropica, Leishmania braziliensis, Pneumocystis pneumonia, Plasmodium vivax, Plasmodium falciparum*, and *Plasmodium malaria*. Examples of helminiths include *Enterobius vermicularis, Trichuris trichiura, Ascaris lumbricoides, Trichinella spiralis, Strongyloides stercoralis, Schistosoma japonicum, Schistosoma mansoni, Schistosoma haematobium*, and hookworms. Viral infectious diseases include those caused by Adenovirus, Lassa fever virus (Arenavirus), Astrovirus, Hantavirus, Rift Valley Fever virus (Phlebovirus), Calicivirus, Ebola virus, Marburg Virus, Japanese encephalitis virus, Dengue virus, Yellow fever virus, Hepatitis C virus, Hepatitis G virus, Hepatitis B virus, Hepatitis D virus, Herpes simplex virus 1, Herpes simplex virus 2, Cytomegalovirus, Epstein Barr virus, Varicella Zoster Virus, Human Herpesvirus 7, Human Herpesvirus 8, Influenza virus, Parainfluenza virus, Rubella virus, Mumps virus, Morbillivirus, Measles virus, Respiratory Syncytial virus, Papillomaviruses, JC virus (Polyomavirus), BK virus (Polyomavirus), Parvovirus, Coxsackie virus (A and B), Hepatitis A virus, Polioviruses, Rhinoviruses, Reovirus, Rabies Virus (Lyssavirus), Human Immunodeficiency virus 1 and 2, and Human T-cell Leukemia virus. A subject having a microbial disease can be identified by routine medical examination, e.g., laboratory tests. For example, microscopy (e.g., Gram-positive and/or Gram-negative staining), sample culturing, biochemical tests (e.g., tests for metabolic and/or enzymatic products, such as fermentation products, acids, alcohol, or gases), and molecular diagnostics (e.g., PCR) may be used. In some embodiments, the subject to be treated by the method described herein may be a human infectious disease patient who has undergone or is subjecting to an antimicrobial therapy, for example, immunotherapy.

Examples of fibrotic conditions include pulmonary fibrosis (e.g., cystic fibrosis, idiopathic pulmonary fibrosis), cirrhosis, biliary atresia, atrial fibrosis, endomyocardial fibrosis, glial scar, arthrofibrosis, Crohn's disease, Dupuytren's contracture, keloid, mediastinal fibrosis, myelofibrosis, nephrogenic systemic fibrosis, progressive massive fibrosis, retroperitoneal fibrosis, and scleroderma/systemic sclerosis. A subject having a fibrotic condition can be identified by routine medical examination, e.g., laboratory tests, CT scans, X-rays, echocardiograms, or ultrasounds. In some embodiments, the subject to be treated by the method described herein may be a human fibrotic patient who has undergone or is subjecting to an anti-fibrotic therapy, for example medication, physical therapy, oxygen therapy, or surgery.

A subject suspected of having any of such target disease/disorder might show one or more symptoms of the disease/disorder. A subject at risk for the disease/disorder can be a subject having one or more of the risk factors for that disease/disorder.

As used herein, "an effective amount" refers to the amount of each active agent required to confer therapeutic effect on the subject, either alone or in combination with one or more other active agents. In some embodiments, the therapeutic effect is reduced Galectin-9 activity and/or amount/expression, reduced Dectin-1 signaling, reduced TIM-3 signaling, reduced CD206 signaling, or increased anti-tumor immune responses in the tumor microenvironment. Non-limiting examples of increased anti-tumor responses include increased activation levels of effector T cells, or switching of the TAMS from the M2 to the M1 phenotype, and increased ADCC responses. Determination of whether an amount of the antibody achieved the therapeutic effect would be evident to one of skill in the art. Effective amounts vary, as recognized by those skilled in the art, depending on the particular condition being treated, the severity of the condition, the individual patient parameters including age, physical condition, size, gender and weight, the duration of the treatment, the nature of concurrent therapy (if any), the specific route of administration and like factors within the knowledge and expertise of the health practitioner. These factors are well known to those of ordinary skill in the art and can be addressed with no more than routine experimentation. It is generally preferred that a maximum dose of the individual components or combinations thereof be used, that is, the highest safe dose according to sound medical judgment.

Empirical considerations, such as the half-life, generally will contribute to the determination of the dosage. For example, antibodies that are compatible with the human immune system, such as humanized antibodies or fully human antibodies, may be used to prolong half-life of the antibody and to prevent the antibody being attacked by the host's immune system. Frequency of administration may be determined and adjusted over the course of therapy, and is generally, but not necessarily, based on treatment and/or suppression and/or amelioration and/or delay of a target disease/disorder. Alternatively, sustained continuous release formulations of an antibody may be appropriate. Various formulations and devices for achieving sustained release are known in the art.

In one example, dosages for an antibody as described herein may be determined empirically in individuals who have been given one or more administration(s) of the antibody. Individuals are given incremental dosages of the antagonist. To assess efficacy of the antagonist, an indicator of the disease/disorder can be followed.

Generally, for administration of any of the antibodies described herein, such as those described in Table 1 or Table 2 herein, such as for example, antibody 9.2-17 and antibody 9.1-8mut1, an initial candidate dosage can be about 2 mg/kg. For the purpose of the present disclosure, a typical daily dosage might range from about any of 0.1 µg/kg to 3 µg/kg to 30 µg/kg to 300 µg/kg to 3 mg/kg, to 30 mg/kg to 100 mg/kg or more, depending on the factors mentioned above. For repeated administrations over several days or longer, depending on the condition, the treatment is sustained until a desired suppression of symptoms occurs or until sufficient therapeutic levels are achieved to alleviate a target disease or disorder, or a symptom thereof. An exemplary dosing regimen comprises administering an initial dose of about 2 mg/kg, followed by a weekly maintenance dose of about 1 mg/kg of the antibody, or followed by a maintenance dose of about 1 mg/kg every other week. However, other dosage regimens may be useful, depending on the pattern of pharmacokinetic decay that the practitioner wishes to achieve. For example, dosing from one-four times a week is contemplated. In some embodiments, dosing ranging from about 3 µg/mg to about 2 mg/kg (such as about 3 µg/mg, about 10 µg/mg, about 30 µg/mg, about 100 µg/mg, about 300 µg/mg, about 1 mg/kg, and about 2 mg/kg) may be used. In some embodiments, dosing frequency is once every week, every 2 weeks, every 4 weeks, every 5 weeks, every 6 weeks, every 7 weeks, every 8 weeks, every 9 weeks, or every 10 weeks; or once every month, every 2 months, or every 3 months, or longer. The progress of this therapy is easily monitored by conventional techniques and assays. The dosing regimen (including the antibody used) can vary over time.

In some embodiments, for an adult patient of normal weight, doses ranging from about 0.3 to 5.00 mg/kg may be administered. In some examples, the dosage of the anti-Galectin-9 antibody described herein can be 10 mg/kg. The particular dosage regimen, i.e., dose, timing and repetition, will depend on the particular individual and that individual's medical history, as well as the properties of the individual agents (such as the half-life of the agent, and other considerations well known in the art).

For the purpose of the present disclosure, the appropriate dosage of an antibody as described herein will depend on the specific antibody, antibodies, and/or non-antibody peptide (or compositions thereof) employed, the type and severity of the disease/disorder, whether the antibody is administered for preventive or therapeutic purposes, previous therapy, the patient's clinical history and response to the antagonist, and the discretion of the attending physician. Typically, the clinician will administer an antibody, until a dosage is reached that achieves the desired result. In some embodiments, the desired result is an increase in anti-tumor immune response in the tumor microenvironment. Methods of determining whether a dosage resulted in the desired result would be evident to one of skill in the art. Administration of one or more antibodies can be continuous or intermittent, depending, for example, upon the recipient's physiological condition, whether the purpose of the administration is therapeutic or prophylactic, and other factors known to skilled practitioners. The administration of an antibody may be essentially continuous over a preselected period of time or may be in a series of spaced dose, e.g., either before, during, or after developing a target disease or disorder.

As used herein, the term "treating" refers to the application or administration of a composition including one or more active agents to a subject, who has a target disease or disorder, a symptom of the disease/disorder, or a predisposition toward the disease/disorder, with the purpose to cure, heal, alleviate, relieve, alter, remedy, ameliorate, improve, or affect the disorder, the symptom of the disease, or the predisposition toward the disease or disorder.

Alleviating a target disease/disorder includes delaying the development or progression of the disease, or reducing disease severity or prolonging survival. Alleviating the disease or prolonging survival does not necessarily require curative results. As used therein, "delaying" the development of a target disease or disorder means to defer, hinder, slow, retard, stabilize, and/or postpone progression of the disease. This delay can be of varying lengths of time, depending on the history of the disease and/or individuals being treated. A method that "delays" or alleviates the development of a disease, or delays the onset of the disease, is a method that reduces probability of developing one or more symptoms of the disease in a given time frame and/or reduces extent of the symptoms in a given time frame, when compared to not using the method. Such comparisons are typically based on clinical studies, using a number of subjects sufficient to give a statistically significant result.

"Development" or "progression" of a disease means initial manifestations and/or ensuing progression of the disease. Development of the disease can be detectable and assessed using standard clinical techniques as well known in the art. However, development also refers to progression that may be undetectable. For purpose of this disclosure, development or progression refers to the biological course of the symptoms. "Development" includes occurrence, recurrence, and onset. As used herein "onset" or "occurrence" of a target disease or disorder includes initial onset and/or recurrence.

In some embodiments, the antibodies described herein, e.g., in Table 1 and/or Table 2, including, but not limited to, 9.2-17 and 9.1-8mut13, are administered to a subject in need of the treatment at an amount sufficient to inhibit the activity of Galectin-9 (and/or Dectin-1 or TIM-3 or CD206) in immune suppressive immune cells in a tumor by at least 20% (e.g., 30%, 40%, 50%, 60%, 70%, 80%, 90% or greater) in vivo. In other embodiments, the antibodies described herein, e.g., in Table 1 and/or Table 2, including, but not limited to, 9.2-17 and 9.1-8mut13, are administered in an amount effective in reducing the activity level of Galectin-9 (and/or Dectin-1 or TIM-3 or CD206) in immune suppressive immune cells in a tumor by at least 20% (e.g., 30%, 40%, 50%, 60%, 70%, 80%, 90% or greater) (as compared to levels prior to treatment or in a control subject). In some embodiments, the antibodies described herein, e.g., in Table 1 and/or Table 2, including, but not limited to, 9.2-17 and 9.1-8mut13, are administered to a subject in need of the treatment at an amount sufficient to promote M1-like programming in TAMs by at least 20% (e.g., 30%, 40%, 50%, 60%, 70%, 80%, 90% or greater) in vivo (as compared to levels prior to treatment or in a control subject).

In some embodiments, the antibodies described herein, e.g., in Table 1 and/or Table 2, including, but not limited to, 9.2-17 and 9.1-8mut13, are administered to a subject in need thereof at an amount sufficient to promote ADCC in target cells in a tumor. In some embodiments, the antibodies described herein, e.g., in Table 1 and/or Table 2, including, but not limited to, 9.2-17 and 9.1-8mut13, are administered to a subject in need of the treatment at an amount sufficient to promote ADCC in target cells in a tumor by at least 20% (e.g., 30%, 40%, 50%, 60%, 70%, 80%, 90% or greater) in vivo (as compared to levels prior to treatment or in a control subject).

In some embodiments, the antibodies described herein, e.g., in Table 1 and/or Table 2, including, but not limited to, 9.2-17 and 9.1-8mut13, are administered to a subject in need of the treatment at an amount sufficient to promote CDC in target cells in a tumor. In some embodiments, the antibodies described herein, e.g., in Table 1 and/or Table 2, including, but not limited to, 9.2-17 and 9.1-8mut13, are administered to a subject in need of the treatment at an amount sufficient to promote CDC in target cells in a tumor by at least 20% (e.g., 30%, 40%, 50%, 60%, 70%, 80%, 90% or greater) in vivo (as compared to levels prior to treatment or in a control subject).

In some embodiments, the antibodies described herein, e.g., in Table 1 and/or Table 2, including, but not limited to, 9.2-17 and 9.1-8mut13, are administered to a subject in need of the treatment at an amount sufficient to promote ADCP in target cells in a tumor. In some embodiments, the antibodies described herein, e.g., in Table 1 and/or Table 2, including, but not limited to, 9.2-17 and 9.1-8mut13, are administered to a subject in need of the treatment at an amount sufficient to promote ADCP in target cells in a tumor by at least 20% (e.g., 30%, 40%, 50%, 60%, 70%, 80%, 90% or greater) in vivo (as compared to levels prior to treatment or in a control subject).

In some embodiments, the antibodies described herein, e.g., in Table 1 and/or Table 2, including, but not limited to, 9.2-17 and 9.1-8mut13, are administered to a subject in need of the treatment at an amount sufficient to promote T cell activation in a tumor. In some embodiments, the antibodies described herein, e.g., in Table 1 and/or Table 2, including, but not limited to, 9.2-17 and 9.1-8mut13, are administered to a subject in need of the treatment at an amount sufficient to promote T cell activation in a tumor by at least 20% (e.g., 30%, 40%, 50%, 60%, 70%, 80%, 90% or greater) in vivo (as compared to levels prior to treatment or in a control subject).

In some embodiments, the antibodies described herein, e.g., in Table 1 and/or Table 2, including, but not limited to, 9.2-17 and 9.1-8mut13, are administered to a subject in need of the treatment at an amount sufficient to promote CD4+ T cell activation in a tumor. In some embodiments, the antibodies described herein, e.g., in Table 1 and/or Table 2, including, but not limited to, 9.2-17 and 9.1-8mut13, are administered to a subject in need of the treatment at an amount sufficient to promote CD4+ T cell activation in a tumor by at least 20% (e.g., 30%, 40%, 50%, 60%, 70%, 80%, 90% or greater) in vivo (as compared to levels prior to treatment or in a control subject).

In some embodiments, the antibodies described herein, e.g., in Table 1 and/or Table 2, including, but not limited to, 9.2-17 and 9.1-8mut13, are administered to a subject in need of the treatment at an amount sufficient to induce CD44 expression in CD4+ cells in a tumor. In some embodiments, the antibodies described herein, e.g., in Table 1 and/or Table 2, including, but not limited to, 9.2-17 and 9.1-8mut13, are administered to a subject in need of the treatment at an amount sufficient to induce CD44 expression in CD4+ cells in a tumor by at least 20% (e.g., 30%, 40%, 50%, 60%, 70%, 80%, 90% or greater) in vivo (as compared to levels prior to treatment or in a control subject).

In some embodiments, the antibodies described herein, e.g., in Table 1 and/or Table 2, including, but not limited to, 9.2-17 and 9.1-8mut13, are administered to a subject in need of the treatment at an amount sufficient to induce TNFalpha expression in CD4+ cells in a tumor. In some embodiments, the antibodies described herein, e.g., in Table 1 and/or Table 2, including, but not limited to, 9.2-17 and 9.1-8mut13, are administered to a subject in need of the treatment at an amount sufficient to induce TNFalpha expression in CD4+ cells in a tumor by at least 20% (e.g., 30%, 40%, 50%, 60%, 70%, 80%, 90% or greater) in vivo (as compared to levels prior to treatment or in a control subject).

In some embodiments, the antibodies described herein, e.g., in Table 1 and/or Table 2, including, but not limited to, 9.2-17 and 9.1-8mut13, are administered to a subject in need of the treatment at an amount sufficient to promote CD8+ T cell activation in a tumor. In some embodiments, the antibodies described herein, e.g., in Table 1 and/or Table 2, including, but not limited to, 9.2-17 and 9.1-8mut13, are administered to a subject in need of the treatment at an amount sufficient to promote CD8+ T cell activation in a tumor by at least 20% (e.g., 30%, 40%, 50%, 60%, 70%, 80%, 90% or greater) in vivo (as compared to levels prior to treatment or in a control subject).

In some embodiments, the antibodies described herein, e.g., in Table 1 and/or Table 2, including, but not limited to, 9.2-17 and 9.1-8mut13, are administered to a subject in need of the treatment at an amount sufficient to induce CD44 expression in CD8+ cells in a tumor. In some embodiments, the antibodies described herein, e.g., in Table 1 and/or Table 2, including, but not limited to, 9.2-17 and 9.1-8mut13, are administered to a subject in need of the treatment at an amount sufficient to induce CD44 expression in CD8+ cells in a tumor by at least 20% (e.g., 30%, 40%, 50%, 60%, 70%, 80%, 90% or greater) in vivo (as compared to levels prior to treatment or in a control subject).

In some embodiments, the antibodies described herein, e.g., in Table 1 and/or Table 2, including, but not limited to, 9.2-17 and 9.1-8mut13, are administered to a subject in need of the treatment at an amount sufficient to induce TNFalpha expression in CD8+ cells in a tumor. In some embodiments, the antibodies described herein, e.g., in Table 1 and/or Table 2, including, but not limited to, 9.2-17 and 9.1-8mut13, are administered to a subject in need of the treatment at an amount sufficient to induce TNFalpha expression in CD8+ cells in a tumor by at least 20% (e.g., 30%, 40%, 50%, 60%, 70%, 80%, 90% or greater) in vivo (as compared to levels prior to treatment or in a control subject).

In any of these embodiments, the antibodies described herein, e.g., in Table 1 and/or Table 2, including, but not limited to, 9.2-17 and 9.1-8mut13, are administered to a subject having cancer, wherein the cancer is selected from pancreatic cancer, e.g., pancreatic ductal adenocarcinoma, cholangiocarcinoma, hepatocellular carcinoma, colorectal cancer, melanoma, renal cell carcinoma, and acute myeloid leukemia.

An analysis was conducted by the inventors using TCGA (The Cancer Genome Atlas) RNA Seq data from 29 different types of solid tumors utilizing approximately 40,000 individual samples, to analyze the correlation between T cell infiltration in a particular tumor type and levels of PD1, PD-L1, IFNgamma and TNF alpha expression. Tumor types were ranked by median expression for a given gene. Gene expression for 4 TCR components (CD3d, CD3e, CD3g, CD3z) and the T cell specific effector protein kinase ZAP70 were used to establish the relative level of T cell association with a given tumor type. TBX21, a Th1 cell-specific transcription factor that controls the expression of the hallmark Th1 cytokines interferon-gamma (IFNg) and tumor necrosis factor (TNF) was also evaluated.

According to the analysis, T cell association levels (surrogate for T cell infiltration) with individual tumor types is generally proportional to the ranking of IFNg expression with the exception of pancreatic cancer (PDA). In PDA the level of IFNg transcription is significantly suppressed suggesting over that observed in other solid tumors implying that the immunosuppressive environment of PDA is particularly robust. In this dataset, the expression of TNF does not generally correlate with the degree of T cell infiltration. Of note, under most conditions TNF is produced by activated macrophages with less contribution by Th1 T cells, NK cells, neutrophils, mast cells, and eosinophils.

Without wishing to be bound by theory, increasing levels of IFNgamma may be particularly useful to combat the immunosuppressive environment and re-activate myeloid and lymphoid response particularly in PDA. Accordingly, in one embodiment, methods of increasing levels of IFNgamma in a cancer are provided herein, wherein the method comprises administering an anti-Galectin-9 antibody, e.g., as described herein in Table 1 and/or Table 2, including, but not limited to, antibody 9.1-8m13 and/or antibody 9.2-17, and wherein the levels of IFNgamma in the cancer are low prior prior the administration, e.g., as assessed relative to levels of expression of T cell markers. In some embodiments the cancer is PDA.

Accordingly, in some embodiments, methods of increasing levels of IFNgamma in a cancer are provided herein, wherein the method comprises administering an anti-Galectin-9 antibody, e.g., as described herein in Table 1 and/or Table 2, including, but not limited to, antibody 9.1-8m13 and/or antibody 9.2-17, and wherein the cancer is PDA. In some embodiments, methods are provided herein, wherein the antibodies described herein, e.g., in Table 1 and/or Table 2, including, but not limited to, 9.2-17 and 9.1-8mut13, are administered to a subject in need of the treatment at an amount sufficient to induce IFNgamma expression in effector T cells in a tumor. In some embodiments, the antibodies described herein, e.g., in Table 1 and/or Table 2, including, but not limited to, 9.2-17 and 9.1-8mut13, are administered to a subject in need of the treatment at an amount sufficient to induce IFNgamma expression in effector T cells in a tumor. In In some embodiments, the antibodies described herein, e.g., in Table 1 and/or Table 2, including, but not limited to, 9.2-17 and 9.1-8mut13, are administered to a subject in need of the treatment at an amount sufficient to induce IFNgamma expression in CD4+ cells in a tumor by at least 20% (e.g., 30%, 40%, 50%, 60%, 70%, 80%, 90% or greater) in vivo (as compared to levels prior to treatment or in a control subject).

In some embodiments, methods are provided herein, wherein the antibodies described herein, e.g., in Table 1 and/or Table 2, including, but not limited to, 9.2-17 and 9.1-8mut13, are administered to a subject in need of the treatment at an amount sufficient to induce IFNgamma expression in CD4+ cells in a tumor. In some embodiments, the antibodies described herein, e.g., in Table 1 and/or Table 2, including, but not limited to, 9.2-17 and 9.1-8mut13, are administered to a subject in need of the treatment at an amount sufficient to induce IFNgamma expression in CD4+ cells in a tumor. In some embodiments, the antibodies described herein, e.g., in Table 1 and/or Table 2, including, but not limited to, 9.2-17 and 9.1-8mut13, are administered to a subject in need of the treatment at an amount sufficient to induce IFNgamma expression in CD4+ cells in a tumor by at least 20% (e.g., 30%, 40%, 50%, 60%, 70%, 80%, 90% or greater) in vivo (as compared to levels prior to treatment or in a control subject).

In some embodiments, methods are provided herein, wherein the antibodies described herein, e.g., in Table 1 and/or Table 2, including, but not limited to, 9.2-17 and 9.1-8mut13, are administered to a subject in need of the treatment at an amount sufficient to induce IFNgamma expression in CD8+ cells in a tumor. In some embodiments, the antibodies described herein, e.g., in Table 1 and/or Table 2, including, but not limited to, 9.2-17 and 9.1-8mut13, are administered to a subject in need of the treatment at an amount sufficient to induce IFNgamma expression in CD8+ cells in a tumor. In some embodiments, the antibodies described herein, e.g., in Table 1 and/or Table 2, including, but not limited to, 9.2-17 and 9.1-8mut13, are administered to a subject in need of the treatment at an amount sufficient to induce IFNgamma expression in CD8+ cells in a tumor by at least 20% (e.g., 30%, 40%, 50%, 60%, 70%, 80%, 90% or greater) in vivo (as compared to levels prior to treatment or in a control subject).

In some embodiments, methods are provided herein, wherein immune cell populations in tumor samples are analyzed in vitro or ex vivo. Accordingly methods are provided herein, wherein the antibodies described herein, e.g., in Table 1 and/or Table 2, including, but not limited to, 9.2-17 and 9.1-8mut13, are provided in vitro or ex vivo at an amount sufficient to induce IFNgamma expression in effector T cells in a tumor. In some embodiments, the antibodies described herein, e.g., in Table 1 and/or Table 2, including, but not limited to, 9.2-17 and 9.1-8mut13, are provided in vitro or ex vivo at an amount sufficient to induce IFNgamma expression in effector T cells in a tumor. In some embodiments, the antibodies described herein, e.g., in Table 1 and/or Table 2, including, but not limited to, 9.2-17 and 9.1-8mut13, induce IFNgamma expression in CD4+ cells in a tumor by at least 20% (e.g., 30%, 40%, 50%, 60%, 70%, 80%, 90% or greater) in vitro or ex vivo. In some embodiments, administration of one or more of the antibodies described herein results in a reduction in tumor size, reduction in tumor growth, elimination of the tumor, reduction in number of metastatic lesions over time, complete response, partial response, or stable disease. Conventional methods, known to those of ordinary skill in the art of medicine, can be used to administer the pharmaceutical composition to the subject, depending upon the type of disease to be treated or the site of the disease. This composition can also be administered via other conventional routes, e.g., administered orally, parenterally, by inhalation spray, topically, rectally, nasally, buccally, vaginally or via an implanted reservoir. The term "parenteral" as used herein includes subcutaneous, intracutaneous, intravenous, intramuscular, intraarticular, intraarterial, intrasynovial, intrasternal, intrathecal, intralesional, intratumoral, and intracranial injection or infusion techniques. In addition, it can be administered to the subject via injectable depot routes of administration such as using 1-, 3-, or 6-month depot injectable or biodegradable materials and methods. In some examples, the pharmaceutical composition is administered intraocularly or intravitreally.

Injectable compositions may contain various carriers such as vegetable oils, dimethylactamide, dimethyformamide, ethyl lactate, ethyl carbonate, isopropyl myristate, ethanol, and polyols (glycerol, propylene glycol, liquid polyethylene glycol, and the like). For intravenous injection, water soluble antibodies can be administered by the drip method, whereby a pharmaceutical formulation containing the antibody and a physiologically acceptable excipient is infused. Physiologically acceptable excipients may include, for example, 5% dextrose, 0.9% saline, Ringer's solution or other suitable excipients. Intramuscular preparations, e.g., a sterile formulation of a suitable soluble salt form of the antibody, can be dissolved and administered in a pharmaceutical excipient such as Water-for-Injection, 0.9% saline, or 5% glucose solution.

In one embodiment, an antibody is administered via site-specific or targeted local delivery techniques. Examples of site-specific or targeted local delivery techniques include various implantable depot sources of the antibody or local delivery catheters, such as infusion catheters, an indwelling catheter, or a needle catheter, synthetic grafts, adventitial wraps, shunts and stents or other implantable devices, site specific carriers, direct injection, or direct application. See, e.g., PCT Publication No. WO 00/53211 and U.S. Pat. No. 5,981,568.

Targeted delivery of therapeutic compositions containing an antisense polynucleotide, expression vector, or subgenomic polynucleotides can also be used. Receptor-mediated DNA delivery techniques are described in, for example, Findeis et al., *Trends Biotechnol.* (1993) 11:202; Chiou et al., Gene Therapeutics: Methods And Applications Of Direct Gene Transfer (J. A. Wolff, ed.) (1994); Wu et al., *J. Biol. Chem.* (1988) 263:621; Wu et al., *J. Biol. Chem.* (1994) 269:542; Zenke et al., *Proc. Natl. Acad. Sci. USA* (1990) 87:3655; Wu et al., *J. Biol. Chem.* (1991) 266:338.

Therapeutic compositions containing a polynucleotide (e.g., those encoding the antibodies described herein) are administered in a range of about 100 ng to about 200 mg of DNA for local administration in a gene therapy protocol. In some embodiments, concentration ranges of about 500 ng to about 50 mg, about 1 µg to about 2 mg, about 5 µg to about 500 µg, and about 20 µg to about 100 µg of DNA or more can also be used during a gene therapy protocol.

The therapeutic polynucleotides and polypeptides described herein can be delivered using gene delivery vehicles. The gene delivery vehicle can be of viral or non-viral origin (see generally, Jolly, *Cancer Gene Therapy* (1994) 1:51; Kimura, *Human Gene Therapy* (1994) 5:845; Connelly, *Human Gene Therapy* (1995) 1:185; and Kaplitt, *Nature Genetics* (1994) 6:148). Expression of such coding sequences can be induced using endogenous mammalian or heterologous promoters and/or enhancers. Expression of the coding sequence can be either constitutive or regulated.

Viral-based vectors for delivery of a desired polynucleotide and expression in a desired cell are well known in the art. Exemplary viral-based vehicles include, but are not limited to, recombinant retroviruses (see, e.g., PCT Publication Nos. WO 90/07936; WO 94/03622; WO 93/25698; WO 93/25234; WO 93/11230; WO 93/10218; WO 91/02805; U.S. Pat. Nos. 5,219,740 and 4,777,127; GB Patent No. 2,200,651; and EP Patent No. 0 345 242), alphavirus-based vectors (e.g., Sindbis virus vectors, Semliki forest virus (ATCC VR-67; ATCC VR-1247), Ross River virus (ATCC VR-373; ATCC VR-1246) and Venezuelan equine encephalitis virus (ATCC VR-923; ATCC VR-1250; ATCC VR 1249; ATCC VR-532)), and adeno-associated virus (AAV) vectors (see, e.g., PCT Publication Nos. WO 94/12649, WO 93/03769; WO 93/19191; WO 94/28938; WO 95/11984 and WO 95/00655). Administration of DNA linked to killed adenovirus as described in Curiel, *Hum. Gene Ther.* (1992) 3:147 can also be employed.

Non-viral delivery vehicles and methods can also be employed, including, but not limited to, polycationic condensed DNA linked or unlinked to killed adenovirus alone (see, e.g., Curiel, *Hum. Gene Ther.* (1992) 3:147); ligand-linked DNA (see, e.g., Wu, *J. Biol. Chem.* (1989) 264: 16985); eukaryotic cell delivery vehicles cells (see, e.g., U.S. Pat. No. 5,814,482; PCT Publication Nos. WO 95/07994; WO 96/17072; WO 95/30763; and WO 97/42338) and nucleic charge neutralization or fusion with cell membranes. Naked DNA can also be employed. Exemplary naked DNA introduction methods are described in PCT Publication No. WO 90/11092 and U.S. Pat. No. 5,580,859. Liposomes that can act as gene delivery vehicles are described in U.S. Pat. No. 5,422,120; PCT Publication Nos. WO 95/13796; WO 94/23697; WO 91/14445; and EP Patent No. 0524968. Additional approaches are described in Philip, Mol. Cell. Biol. (1994) 14:2411, and in Woffendin, Proc. Natl. Acad. Sci. (1994) 91:1581.

The particular dosage regimen, i.e., dose, timing and repetition, used in the method described herein will depend on the particular subject and that subject's medical history.

In some embodiments, more than one antibody, or a combination of an antibody and another suitable therapeutic agent, may be administered to a subject in need of the treatment. The antibody can also be used in conjunction with other agents that serve to enhance and/or complement the effectiveness of the agents. Treatment efficacy for a target disease/disorder can be assessed by methods well-known in the art.

In some embodiments, the disclosure provides a method for suppressing Dectin-1 signaling e.g., in immune suppressive immune cells, e.g., tumor infiltrating immune cells, such as macrophages, the method comprising providing or administering an anti-Galectin-9 antibody described herein, e.g., in Table 1 and/or Table 2, or antigen binding fragment thereof to a subject. In some embodiments, the anti-Galectin-9 antibody is a 9.1-8mut13 antibody and/or a 9.2-17 antibody. In some embodiments, the method suppresses Dectin-1 signaling, e.g., in immune suppressive immune cells, by at least 30% (e.g., 31%, 35%, 40%, 50%, 60%, 70%, 80%, 90%, 95% or greater, including any increment therein).

In some embodiments, the disclosure provides a method for suppressing TIM-3 signaling e.g., in tumor infiltrating immune cells, the method comprising providing or administering an anti-Galectin-9 antibody described herein, e.g., in Table 1 and/or Table 2, or antigen binding fragment thereof to a subject. In some embodiments, the anti-Galectin-9 antibody is a 9.1-8mut13 antibody and/or a 9.2-17 antibody. In some embodiments, the method suppresses the TIM-3 signaling, e.g., in tumor infiltrating immune cells by at least 30% (e.g., 31%, 35%, 40%, 50%, 60%, 70%, 80%, 90%, 95% or greater, including any increment therein).

In some embodiments, the disclosure provides a method for suppressing CD206 signaling, e.g., in tumor infiltrating immune cells, e.g., in macrophages, the method comprising providing or administering an anti-Galectin-9 antibody described herein, e.g., in Table 1 and/or Table 2, or antigen binding fragment thereof to a subject. In some embodiments, the anti-Galectin-9 antibody is a 9.1-8mut13 antibody and/or a 9.2-17 antibody. In some embodiments, the method suppresses the CD206 signaling, e.g., in tumor infiltrating immune cells, e.g., macrophages, by at least 30% (e.g., 31%, 35%, 40%, 50%, 60%, 70%, 80%, 90%, 95% or greater, including any increment therein).

In some embodiments, the disclosure provides a method for inducing cell cytotoxicity, such as ADCC, in target cells expressing Galectin-9, e.g., wherein the target cells are cancer cells or immune suppressive immune cells, the method comprising providing or administering an anti-Galectin-9 antibody described herein, e.g., in Table 1 and/or Table 2, or antigen binding fragment thereof to a subject. In some embodiments, the anti-Galectin-9 antibody is a 9.1-8mut13 antibody and/or a 9.2-17 antibody. In some embodiments, the method induces apoptosis in immune cells such as T cells by at least 30% (e.g., 31%, 35%, 40%, 50%, 60%, 70%, 80%, 90%, 95% or greater, including any increment therein).

In some embodiments, the disclosure provides a method for inducing cell cytotoxicity such as complement-dependent cytotoxicity (CDC) against target cells expressing Galectin-9 in a subject, the method comprising providing or administering an anti-Galectin-9 antibody described herein, e.g., in Table 1 and/or Table 2, or antigen binding fragment thereof to a subject. In some embodiments, the anti-Galectin-9 antibody is a 9.1-8mut13 antibody and/or a 9.2-17 antibody. In some embodiments, the method induces cell cytotoxicity such as complement-dependent cytotoxicity (CDC) against target cells expressing Galectin-9 at least 30% (e.g., 31%, 35%, 40%, 50%, 60%, 70%, 80%, 90%, 95% or greater, including any increment therein).

In some embodiments, the disclosure provides a method for inducing cell cytotoxicity, such as ADCC, e.g., against target cells expressing Galectin-9 in a subject, the method comprising providing or administering an anti-Galectin-9 antibody described herein, e.g., in Table 1 and/or Table 2, or antigen binding fragment thereof to a subject. In some embodiments, the anti-Galectin-9 antibody is a 9.1-8mut13 antibody and/or a 9.2-17 antibody. In some embodiments, the method induces cell cytotoxicity by at least 30% (e.g., 31%, 35%, 40%, 50%, 60%, 70%, 80%, 90%, 95% or greater, including any increment therein).

In some embodiments, the disclosure provides a method for inducing phagocytosis of target cells expressing Galectin-9 (ADCP), the method comprising providing or administering an anti-Galectin-9 antibody described herein, e.g., in Table 1 and/or Table 2, or antigen binding fragment thereof to a subject. In some embodiments, the anti-Galectin-9 antibody is a 9.1-8mut13 antibody and/or a 9.2-17 antibody. In some embodiments, the anti-Galectin-9 antibody increases phagocytosis of target cells by at least 30% (e.g., 31%, 35%, 40%, 50%, 60%, 70%, 80%, 90%, 95% or greater, including any increment therein).

In some embodiments, the disclosure provides a method for inducing cell cytotoxicity such as complement-dependent cytotoxicity (CDC) against target cells expressing Galectin-9, the method comprising providing or administering an anti-Galectin-9 antibody described herein, e.g., in Table 1 and/or Table 2, or antigen binding fragment thereof to a subject. In some embodiments, the anti-Galectin-9 antibody is a 9.1-8mut13 antibody and/or a 9.2-17 antibody. In some embodiments, the method induces cell cytotoxicity against target cells by at least 30% (e.g., 31%, 35%, 40%, 50%, 60%, 70%, 80%, 90%, 95% or greater, including any increment therein).

In some embodiments, the disclosure provides a method for inducing T cell activation, e.g., in tumor infiltrating T cells, i.e., suppress Galectin-9 mediated inhibition of T cell activation, either directly or indirectly, the method comprising providing or administering an anti-Galectin-9 antibody described herein, e.g., in Table 1 and/or Table 2, or antigen binding fragment thereof to a subject. In some embodiments, the anti-Galectin-9 antibody is a 9.1-8mut13 antibody and/or a 9.2-17 antibody. In some embodiments, the method promotes T cell activation by at least 30% (e.g., 31%, 35%, 40%, 50%, 60%, 70%, 80%, 90%, 95% or greater, including any increment therein).

In some embodiments, the disclosure provides a method for promoting CD4+ cell activation, the method comprising providing or administering an anti-Galectin-9 antibody described herein, e.g., in Table 1 and/or Table 2, or antigen binding fragment thereof to a subject. In some embodiments, the anti-Galectin-9 antibody is a 9.1-8mut13 antibody and/or a 9.2-17 antibody. In some embodiments, the method promotes CD4+ cell activation by at least 30% (e.g., 31%, 35%, 40%, 50%, 60%, 70%, 80%, 90%, 95% or greater, including any increment therein).

In some embodiments, the disclosure provides a method for inducing CD44 expression in CD4+ cells, the method comprising providing or administering an anti-Galectin-9 antibody described herein, e.g., in Table 1 and/or Table 2, or antigen binding fragment thereof to a subject. In some embodiments, the anti-Galectin-9 antibody is a 9.1-8mut13 antibody and/or a 9.2-17 antibody. In some embodiments, the method increases CD44 expression in CD4+ cells by at least 30% (e.g., 31%, 35%, 40%, 50%, 60%, 70%, 80%, 90%, 95% or greater, including any increment therein).

In some embodiments, the disclosure provides a method for inducing IFNgamma expression in CD4+ cells, the method comprising providing or administering an anti-Galectin-9 antibody described herein, e.g., in Table 1 and/or Table 2, or antigen binding fragment thereof to a subject. In some embodiments, the anti-Galectin-9 antibody is a 9.1-8mut13 antibody and/or a 9.2-17 antibody. In some embodiments, the method increases IFNgamma expression in CD4+ cells by at least 30% (e.g., 31%, 35%, 40%, 50%, 60%, 70%, 80%, 90%, 95% or greater, including any increment therein).

In some embodiments, the disclosure provides a method for inducing TNFalpha expression in CD4+ cells, the method comprising providing or administering an anti-Galectin-9 antibody described herein, e.g., in Table 1 and/or Table 2, or antigen binding fragment thereof to a subject. In some embodiments, the anti-Galectin-9 antibody is a 9.1-8mut13 antibody and/or a 9.2-17 antibody. In some embodiments, the method increases TNFalpha expression in CD4+ cells by at least 30% (e.g., 31%, 35%, 40%, 50%, 60%, 70%, 80%, 90%, 95% or greater, including any increment therein).

In some embodiments, the disclosure provides a method for inducing CD44 expression in CD8+ cells, the method comprising providing or administering an anti-Galectin-9 antibody described herein, e.g., in Table 1 and/or Table 2, or antigen binding fragment thereof to a subject. In some embodiments, the anti-Galectin-9 antibody is a 9.1-8mut13 antibody and/or a 9.2-17 antibody. In some embodiments, the method increases CD44 expression in CD8+ cells by at least 30% (e.g., 31%, 35%, 40%, 50%, 60%, 70%, 80%, 90%, 95% or greater, including any increment therein).

In some embodiments, the disclosure provides a method for inducing IFNgamma expression in CD8+ cells, the method comprising providing or administering an effective amount of an anti-Galectin-9 antibody described herein, e.g., in Table 1 and/or Table 2, or antigen binding fragment thereof to a subject. In some embodiments, the anti-Galectin-9 antibody is a 9.1-8mut13 antibody and/or a 9.2-17 antibody. In some embodiments, the method increases IFNgamma expression in CD8+ cells by at least 30% (e.g., 31%, 35%, 40%, 50%, 60%, 70%, 80%, 90%, 95% or greater, including any increment therein).

In some embodiments, the disclosure provides a method for inducing TNFalpha expression in CD8+ cells, the method comprising providing or administering an effective amount of an anti-Galectin-9 antibody described herein, e.g., in Table 1 and/or Table 2, or antigen binding fragment thereof to a subject. In some embodiments, the anti-Galectin-9 antibody is a 9.1-8mut13 antibody and/or a 9.2-17 antibody. In some embodiments, the method increases TNFalpha expression in CD8+ cells by at least 30% (e.g., 31%, 35%, 40%, 50%, 60%, 70%, 80%, 90%, 95% or greater, including any increment therein).

In some of these embodiments, the methods comprising providing or administering an effective amount of an anti-Galectin-9 antibody described herein, induce CD44, IFNgamma, and/or TNFalpha in CD4+ and CD8+ cells. The method embodiments described supra, for suppressing Dectin-1 signaling, for suppressing TIM-3 signaling, for suppressing CD206 signaling, for inducing ADCC against target cells, for inducing CDC against target cell, for inducing ADCP against target cells, for inducing T cell activation, for promoting CD4+ cell activation, for inducing CD44 expression in CD4+ cells, for inducing IFNgamma expression in CD4+ cells, for inducing TNFalpha expression in CD4+ cells, for inducing CD44 expression in CD8+ cells, for inducing IFNgamma expression in CD8+ cells, method for inducing TNFalpha expression in CD8+ cells, wherein the method includes administering to a subject in need thereof an effective amount of an anti-Galectin-9 antibody described herein, e.g., in Table 1 and/or Table 2, or antigen binding fragment thereof.

The method embodiments described supra (for suppressing Dectin-1 signaling, for suppressing TIM-3 signaling, for suppressing CD206 signaling, for inducing ADCC against target cells, for inducing CDC against target cell, for inducing ADCP against target cells, for inducing T cell activation, for promoting CD4+ cell activation, for inducing CD44 expression in CD4+ cells, for inducing IFNgamma expression in CD4+ cells, for inducing TNFalpha expression in CD4+ cells, for inducing CD44 expression in CD8+ cells, for inducing IFNgamma expression in CD8+ cells, for inducing TNFalpha expression in CD8+ cells), wherein the method includes providing an effective amount of an anti-Galectin-9 antibody described herein, e.g., in Table 1 and/or Table 2, or antigen binding fragment thereof, to a sample isolated from a tumor, and measuring in vitro or ex vivo one or more parameters selected from Dectin-1 suppression, for TIM-3 suppression, for CD206 suppression, ADCC induction, CDC induction, ADCP induction, induction of T cell activation, promotion of CD4+ cell activation, induction of CD44 expression in CD4+ cells, induction of IFNgamma expression in CD4+ cells, induction of TNFalpha expression in CD4+ cells, induction of CD44 expression in CD8+ cells, induction of IFNgamma expression in CD8+ cells, induction of TNFalpha expression in CD8+ cells.

The in vivo methods embodiments described supra, wherein the subject in need of administration has cancer, and wherein the cancer is selected from pancreatic cancer, e.g., pancreatic ductal adenocarcinoma, cholangiocarcinoma, hepatocellular carcinoma, colorectal cancer, melanoma, renal cell carcinoma, and acute myeloid leukemia. In some embodiments, cancer low levels of IFNgamma expression, relative to expression of T cell markers. In some embodiments, the cancer is PDA.

The in vitro or ex vivo method embodiments described supra, wherein the sample isolated from a tumor is from a cancer selected from pancreatic cancer, e.g., pancreatic ductal adenocarcinoma, cholangiocarcinoma, hepatocellular carcinoma, colorectal cancer, melanoma, renal cell carcinoma, and acute myeloid leukemia.

Combination Therapy

Any of the anti-Galectin-9 antibodies described herein may be utilized in conjunction with other types of therapy for cancer or autoimmune diseases, such as chemotherapy, surgery, radiation, gene therapy, or in conjunction with other types of therapy for autoimmune diseases, such as immunosuppressive mediation, hormone replacement therapy, blood transfusions, anti-inflammatory medication, and/or pain medication and so forth. Such therapies can be administered simultaneously or sequentially (in any order) with the immunotherapy according to the present disclosure.

In some embodiments, methods are provided herein, wherein the anti-Galectin-9 antibodies described herein are utilized in conjunction with other types of therapy for cancer or autoimmune diseases, such as chemotherapy, surgery, radiation, gene therapy, or in conjunction with other types of therapy for autoimmune diseases, such as immunosuppressive mediation, hormone replacement therapy, blood transfusions, anti-inflammatory medication, and/or pain medication and so forth. In some embodiments, the methods include the steps of administering the anti-Galectin-9 antibodies, such as any of the anti-Galectin-9 antibodies described herein, e.g., in Table 1 and/or Table 2, simultaneously or sequentially (in any order) with the immunotherapy according to the present disclosure. When co-administered with an additional therapeutic agent, suitable therapeutically effective dosages for each agent may be lowered due to the additive action or synergy.

In some embodiments, the methods are provided herein, wherein the anti-Galectin-9 antibody, for example antibody 9.2-17 or 9.1-8mut13, is combined with other immunomodulatory treatments such as, e.g., inhibitors of a checkpoint molecule (e.g., PD-1, PD-L1, PD-L2, CTLA-4, LAG3, TIM3, or A2aR), activators of a co-stimulatory receptor (e.g., DX40, GITR, CD137, CD40, CD27, and ICOS), and/or inhibitors of an innate immune cell target (e.g., KIR, NKG2A, CD96, TLR, and IDO). Without being bound by theory, it is thought that anti-Galectin-9 antibodies, through their inhibition of Dectin-1, can reprogram immune responses against tumor cells via, e.g., inhibiting the activity of γδ T cells infiltrated into tumor microenvironment, and/or enhancing immune surveillance against tumor cells by, e.g., activating CD4+ and/or CD8+ T cells. Thus, combined use of an anti-Galectin-9 antibody and an immunomodulatory agent such as those described herein would be expected to significantly enhance anti-tumor efficacy.

In some embodiments, the methods are provided, wherein the anti-Galectin-9 antibody is administered concurrently with a checkpoint inhibitor. In some embodiments, wherein the anti-Galectin-9 antibody is administered before or after a checkpoint inhibitor. In some embodiments, the checkpoint inhibitor is administered systemically. In some embodiments, the checkpoint inhibitor is administered locally.

In some embodiments, the methods are provided, wherein the anti-Galectin-9 antibody, such as any of the Galectin-9 antibodies described herein in Table 1 and/or Table 2, such as 9.2-17 or 9.1-8mut13, is capable of improving anti-tumor activity (e.g., reduced tumor proliferation, size, volume, weight, burden or load, reduction in number of metastatic lesions over time) of the co-administered checkpoint inhibitors (e.g., PD-1, PD-L1 and/or CTLA-4 or others listed herein or known in the art), e.g., by 10%, 20%, 25%, 30%, 40%, 50%, 60%, 70%, 75%, 80%, 85%, 90%, 95%, or more as compared to a checkpoint inhibitor therapy alone under the same conditions. In some embodiments, the anti-Galectin-9 antibody, such as any of the Galectin-9 antibodies described herein in Table 1 and/or Table 2, for example antibody 9.2-17 or antibody 9.1-8mut13, is capable of improving antitumor activity (e.g., tumor proliferation, size, volume, weight, load or burden, or reduction in number of metastatic lesions over time) of the co-administered checkpoint inhibitors (e.g., PD-land/or CTLA-4 e.g., PD-1, PD-L1 and/or CTLA-4 or others listed herein or known in the art), e.g., 1.0-1.2-fold, 1.2-1.4-fold, 1.4-1.6-fold, 1.6-1.8-fold, 1.8-2-fold, or two-fold more or more as compared to a checkpoint inhibitor therapy alone under the same conditions. In some embodiments, the anti-Galectin-9 antibody, such as any of the Galectin-9 antibodies described herein in Table 1 and/or Table 2, including but not limited to antibody 9.1-8m13 and/or antibody 9.2-17, is capable of improving antitumor activity (e.g., tumor proliferation, size, volume, weight, load or burden or reduction in number of metastatic lesions over time) of the co-administered checkpoint inhibitor (e.g., PD-1, PD-L1 and/or CTLA-4 or others listed herein or known in the art), e.g., about three-fold, four-fold, about threefold, four-fold, five-fold, six-fold, seven-fold, eight-fold, nine-fold, ten-fold, or more as compared to a checkpoint inhibitor therapy alone under the same conditions. In some embodiments, the co-administered checkpoint inhibitors (e.g., PD-1, PD-L1 and/or CTLA-4 or others listed herein or known in the art) are capable of improving anti-tumor activity of the anti-Galectin-9 antibody, such as any of the Galectin-9 antibodies described herein in Table 1 and/or Table 2, including but not limited to antibody 9.1-8m13 and/or antibody 9.2-17, (e.g., tumor proliferation, size, volume, weight, burden or load or reduction in number of metastatic lesions), e.g., by 10%, 20%, 25%, 30%, 40%, 50%, 60%, 70%, 75%, 80%, 85%, 90%, 95%, or more as compared to anti-Galectin-9 therapy alone under the same conditions. In some embodiments, the co-administered checkpoint inhibitors (e.g., PD-1, PD-L1 and/or CTLA-4 or others listed herein or known in the art) are capable of improving antitumor activity (e.g., tumor proliferation, size, volume, weight, load or burden or reduction in number of metastatic lesions over time) of the anti-Galectin-9 antibody, such as any of the Galectin-9 antibodies described herein in Table 1 and/or Table 2, including but not limited to antibody 9.1-8m13 and/or antibody 9.2-17, e.g., 1.0-1.2-fold, 1.2-1.4-fold, 1.4-1.6-fold, 1.6-1.8-fold, 1.8-2-fold, or two-fold more or more as compared to an anti-Galectin-9 therapy alone under the same conditions. In some embodiments, the co-administered checkpoint inhibitors (e.g., PD-1, PD-L1 and/or CTLA-4 or others described herein or known in the art) are capable of improving antitumor activity (e.g., tumor proliferation, size, volume, weight, load or burden or reduction in number of metastatic lesions over time) of the anti-Galectin-9 antibody, such as any of the Galectin-9 antibodies described herein in Table 1 and/or Table 2, including but not limited to, antibody 9.1-8m13 and/or antibody 9.2-17, e.g., about three-fold, four-fold, about threefold, four-fold, five-fold, six-fold, seven-fold, eight-fold, nine-fold, ten-fold, or more as compared to a anti-Galectin-9 therapy alone under the same conditions.

In some embodiments, the methods are provided, wherein the anti-Galectin-9 antibody, such as any of the Galectin-9 antibodies described herein in Table 1 and/or Table 2, including but not limited to, antibody 9.1-8m13 and/or antibody 9.2-17, is capable of improving the ability of the immunotherapy to activate T cells (e.g., as measured by cytokine markers described herein) (e.g., as described herein or known in the art), e.g., by 10%, 20%, 25%, 30%, 40%, 50%, 60%, 70%, 75%, 80%, 85%, 90%, 95%, or more as compared to a immunotherapy therapy alone under the same conditions. In some embodiments, the anti-Galectin-9 antibody is capable of improving the ability of the immunotherapy to activate T cells (e.g., as measured by cytokine markers described herein) (e.g., as described herein or known in the art), e.g., 1.0-1.2-fold, 1.2-1.4-fold, 1.4-1.6-fold, 1.6-1.8-fold, 1.8-2-fold, or two-fold more or more as compared to a immunotherapy therapy alone under the same conditions. In some embodiments, the anti-Galectin-9 antibody, such as any of the Galectin-9 antibodies described herein in Table 1 and/or Table 2, including but not limited to, antibody 9.1-8m13 and/or antibody 9.2-17, is capable of improving the ability of the immunotherapy to activate T cells (e.g., as measured by cytokine markers described herein) (e.g., as described herein or known in the art), e.g., about three-fold, four-fold, about threefold, four-fold, five-fold, six-fold, seven-fold, eight-fold, nine-fold, ten-fold, or more as compared to a immunotherapy therapy alone under the same conditions.

In some embodiments, the methods are provided, wherein the co-administered immunotherapies (e.g., as described herein or known in the art) are capable of improving the ability of the anti-Galectin-9 antibody, such as any of the Galectin-9 antibodies described herein in Table 1 and/or Table 2, including but not limited to, antibody 9.1-8m13 and/or antibody 9.2-17, to activate T cells (e.g., as measured by cytokine markers described herein), e.g., by 10%, 20%, 25%, 30%, 40%, 50%, 60%, 70%, 75%, 80%, 85%, 90%, 95%, or more as compared to an anti-Galectin-9 therapy alone under the same conditions. In some embodiments, the co-administered immunotherapies (e.g., as described herein or known in the art) are capable of improving the ability of the anti-Galectin-9 antibody to activate T cells (e.g., as measured by cytokine markers described herein), e.g., 1.0-1.2-fold, 1.2-1.4-fold, 1.4-1.6-fold, 1.6-1.8-fold, 1.8-2-fold, or two-fold more or more as compared to an anti-Galectin-9 therapy alone under the same conditions. In some embodiments, the co-administered immunotherapies (e.g., as described herein or known in the art) are capable of improving the ability of the anti-Galectin-9 antibody to activate T cells (e.g., as measured by cytokine markers described herein), e.g., about three-fold, four-fold, about threefold, four-fold, five-fold, six-fold, seven-fold, eight-fold, nine-fold, ten-fold, or more as compared to an anti-Galectin-9 therapy alone under the same conditions.

In other embodiments, the methods are provided herein, wherein the anti-Galectin-9 antibody, such as any of the Galectin-9 antibodies described herein in Table 1 and/or Table 2, including but not limited to, antibody 9.1-8m13 and/or antibody 9.2-17, is administered in combination with one or more of the existing modalities for treating autoimmune disorders including, but not limited to: intravenous Ig therapy, nonsteroidal anti-inflammatory drugs (NSAID), and corticosteroids; and anti-inflammatory treatments such as cyclosporins, rapamycins or ascomycins, or their immuno-suppressive analogs, e.g., cyclosporin A, cyclosporin G, FK-506, rapamycin, 40-O-(2-hydroxy)ethyl-rapamycin etc.; cyclophosphamide; azathioprene; methotrexate; brequinar; FTY 720; leflunomide; mnizoribine; mycophenolic acid; mycophenolate mofetil; 15-deoxyspergualine; immunosuppressive monoclonal antibodies, e.g., monoclonal antibodies to leukocyte receptors, e.g., MHC, CD2, CD3, CD4, CD7, CD25, CD28, B7, CD45, or CD58 or their ligands; or other immunomodulatory compounds, e.g., CTLA4Ig, or other adhesion molecule inhibitors, e.g. mAbs or low molecular weight inhibitors including selectin antagonists and VLA-4 antagonists. These combination therapies can be part of an immunomodulating regimens or a regimen for the treatment or prevention of inflammatory disorders or autoimmune disorders.

In some embodiments, the methods are provided, wherein the anti-Galectin-9 antibody, such as any of the Galectin-9 antibodies described herein in Table 1 and/or Table 2, including but not limited to, antibody 9.1-8m13 and/or antibody 9.2-17, can also be co-used with a chemotherapeutic agent, including alkylating agents, anthracyclines, cytoskeletal disruptors (Taxanes), epothilones, histone deacetylase inhibitors, inhibitors of topoisomerase I, inhibitors of topoisomerase II, kinase inhibitors, nucleotide analogs and precursor analogs, peptide antibiotics, platinum-based agents, retinoids, vinca alkaloids and derivatives thereof.

Non-limiting examples include: (i) anti-angiogenic agents (e.g., TNP-470, platelet factor 4, thrombospondin-1, tissue inhibitors of metalloproteases (TIMP1 and TIMP2), prolactin (16-Kd fragment), angiostatin (38-Kd fragment of plasminogen), endostatin, bFGF soluble receptor, transforming growth factor beta, interferon alpha, soluble KDR and FLT-1 receptors, placental proliferin-related protein, as well as those listed by Carmeliet and Jain (2000)); (ii) a VEGF antagonist or a VEGF receptor antagonist such as anti-VEGF antibodies, VEGF variants, soluble VEGF receptor fragments, aptamers capable of blocking VEGF or VEGFR, neutralizing anti-VEGFR antibodies, inhibitors of VEGFR tyrosine kinases and any combinations thereof; and (iii) chemotherapeutic compounds such as, e.g., pyrimidine analogs (5-fluorouracil, floxuridine, capecitabine, gemcitabine and cytarabine), purine analogs, folate antagonists and related inhibitors (mercaptopurine, thioguanine, pentostatin and 2-chlorodeoxyadenosine (cladribine)); antiproliferative/antimitotic agents including natural products such as vinca alkaloids (vinblastine, vincristine, and vinorelbine), microtubule disruptors such as taxane (paclitaxel, docetaxel), vincristine, vinblastine, nocodazole, epothilones, and navelbine, epidipodophyllotoxins (etoposide and teniposide), DNA damaging agents (actinomycin, amsacrine, anthracyclines, bleomycin, busulfan, camptothecin, carboplatin, chlorambucil, cisplatin, cyclophosphamide, cytoxan, dactinomycin, daunorubicin, doxorubicin, epirubicin, hexamethyhnelamineoxaliplatin, iphosphamide, melphalan, merchlorehtamine, mitomycin, mitoxantrone, nitrosourea, plicamycin, procarbazine, taxol, taxotere, teniposide, triethylenethiophosphoramide and etoposide (VP16)); antibiotics such as dactinomycin (actinomycin D), daunorubicin, doxorubicin (adriamycin), idarubicin, anthracyclines, mitoxantrone, bleomycin, plicamycin (mithramycin) and mitomycin; enzymes (L-asparaginase which systemically metabolizes L-asparagine and deprives cells which do not have the capacity to synthesize their own asparagine); antiplatelet agents; antiproliferative/antimitotic alkylating agents such as nitrogen mustards (mechlorethamine, cyclophosphamide and analogs, melphalan, chlorambucil), ethylenimines and methylmelamines (hexamethylmelamine and thiotepa), alkyl sulfonates-busulfan, nitrosoureas (carmustine (BCNU) and analogs, streptozocin), trazenes-dacarbazinine (DTIC); antiproliferative/antimitotic antimetabolites such as folic acid analogs (methotrexate); platinum coordination complexes (cisplatin, carboplatin), procarbazine, hydroxyurea, mitotane, aminoglutethimide; hormones, hormone analogs (estrogen, tamoxifen, goserelin, bicalutamide, nilutamide) and aromatase inhibitors (letrozole, anastrozole); anticoagulants (heparin, synthetic heparin salts and other inhibitors of thrombin); fibrinolytic agents (such as tissue plasminogen activator, streptokinase and urokinase), aspirin, dipyridamole, ticlopidine, clopidogrel, abciximab; antimigratory agents; antisecretory agents (breveldin); immunosuppressives (cyclosporine, tacrolimus (FK-506), sirolimus (rapamycin), azathioprine, mycophenolate mofetil); anti-angiogenic compounds (e.g., TNP-470, genistein, bevacizumab) and growth factor inhibitors (e.g., fibroblast growth factor (FGF) inhibitors); angiotensin receptor blocker; nitric oxide donors; anti-sense oligonucleotides; antibodies (trastuzumab); cell cycle inhibitors and differentiation inducers (tretinoin); mTOR inhibitors, topoisomerase inhibitors (doxorubicin (adriamycin), amsacrine, camptothecin, daunorubicin, dactinomycin, eniposide, epirubicin, etoposide, idarubicin, mitoxantrone, topotecan, and irinotecan), corticosteroids (cortisone, dexamethasone, hydrocortisone, methylprednisolone, prednisone, and prednisolone); growth factor signal transduction kinase inhibitors; mitochondrial dysfunction inducers and caspase activators; and chromatin disruptors.

In some embodiments, methods are provided herein wherein the anti-Galectin-9 antibody, such as any of the Galectin-9 antibodies described herein in Table 1 and/or Table 2, including but not limited to, antibody 9.1-8m13 and/or antibody 9.2-17, is administered concurrently with a chemotherapeutic agent. In some embodiments, methods are provided herein, wherein the anti-Galectin-9 antibody is administered before or after a chemotherapeutic agent. In some embodiments, methods are provided herein, wherein the chemotherapeutic agent is administered systemically. In some embodiments, methods are provided herein, wherein the chemotherapeutic agent is administered locally.

In some embodiments, the methods are provided, wherein the anti-Galectin-9 antibody, such as any of the antibodies described herein in Table 1 and/or Table 2, for example antibody 9.2-17 or antibody 9.1-8mut13, is capable of improving anti-tumor activity (e.g., tumor proliferation, size, volume, weight, burden load or reduction in number of metastatic lesions over time) of the co-administered chemotherapeutic agents (e.g., as described herein or known in the art), e.g., by 10%, 20%, 25%, 30%, 40%, 50%, 60%, 70%, 75%, 80%, 85%, 90%, 95%, or more as compared to a chemotherapeutic agent therapy alone under the same conditions. In some embodiments, the anti-Galectin-9 antibody is capable of improving antitumor activity (e.g., tumor proliferation, size, volume, weight, load or burden or reduction in number of metastatic lesions over time) of the co-administered chemotherapeutic agents (e.g., as described herein or known in the art), e.g., 1.0-1.2-fold, 1.2-1.4-fold, 1.4-1.6-fold, 1.6-1.8-fold, 1.8-2-fold, or two-fold more or more as compared to a chemotherapeutic agent therapy alone under the same conditions. In some embodiments, the anti-Galectin-9 antibody is capable of improving antitumor activity (e.g., tumor proliferation, size, volume, weight, load or burden or reduction in number of metastatic lesions over time) of the co-administered chemotherapeutic agent (e.g., as described herein or known in the art), e.g., about three-fold, four-fold, about threefold, four-fold, five-fold, six-fold, seven-fold, eight-fold, nine-fold, ten-fold, or more as compared to a chemotherapeutic agent therapy alone under the same conditions.

In some embodiments, the methods are provided, wherein the co-administered chemotherapeutic agents (e.g., as described herein or known in the art) are capable of improving anti-tumor activity of the anti-Galectin-9 antibody, such as any of the antibodies described herein in Table 1 and/or Table 2, for example antibody 9.2-17 or antibody 9.1-8mut13, (e.g., tumor proliferation, size, volume, weight, burden or load or reduction in number of metastatic lesions over time) of, e.g., by 10%, 20%, 25%, 30%, 40%, 50%, 60%, 70%, 75%, 80%, 85%, 90%, 95%, or more as compared to an anti-Galectin-9 therapy alone under the same conditions. In some embodiments, the co-administered chemotherapeutic agents (e.g., as described herein or known in the art) are capable of improving anti-tumor activity (e.g., tumor proliferation, size, volume, weight, burden or load or reduction in number of metastatic lesions over time) of the anti-Galectin-9 antibody, e.g., 1.0-1.2-fold, 1.2-1.4-fold, 1.4-1.6-fold, 1.6-1.8-fold, 1.8-2-fold, or two-fold more or more as compared to an anti-Galectin-9 therapy alone under the same conditions. In some embodiments, the co-administered chemotherapeutic agents (e.g., as described herein or known in the art) are capable of improving antitumor activity (e.g., tumor proliferation, size, volume, weight, load or burden or reduction in number of metastatic lesions over time) of the anti-Galectin-9 antibody, e.g., about three-fold, four-fold, about threefold, four-fold, five-fold, six-fold, seven-fold, eight-fold, nine-fold, ten-fold, or more as compared to an anti-Galectin-9 therapy alone under the same conditions.

In some embodiments methods are provided herein, wherein the anti-Galectin-9 antibody, such as any of the antibodies described herein in Table 1 and/or Table 2, for example antibody 9.2-17 or antibody 9.1-8mut13, is capable of improving the ability of the chemotherapeutic agent to activate T cells (e.g., as measured by cytokine markers described herein) (e.g., as described herein or known in the art), e.g., by 10%, 20%, 25%, 30%, 40%, 50%, 60%, 70%, 75%, 80%, 85%, 90%, 95%, or more as compared to a chemotherapeutic agent therapy alone under the same conditions. In some embodiments, the anti-Galectin-9 antibody is capable of improving the ability of the chemotherapeutic agent to activate T cells (e.g., as measured by cytokine markers described herein) (e.g., as described herein or known in the art), e.g., 1.0-1.2-fold, 1.2-1.4-fold, 1.4-1.6-fold, 1.6-1.8-fold, 1.8-2-fold, or two-fold more or more as compared to a chemotherapeutic agent therapy alone under the same conditions. In some embodiments, the anti-Galectin-9 antibody is capable of improving the ability of the chemotherapeutic agent to activate T cells (e.g., as measured by cytokine markers described herein) (e.g., as described herein or known in the art), e.g., about three-fold, four-fold, about threefold, four-fold, five-fold, six-fold, seven-fold, eight-fold, nine-fold, ten-fold, or more as compared to a chemotherapeutic agent therapy alone under the same conditions.

In some embodiments, methods are provided herein, wherein the co-administered chemotherapeutic agents (e.g., as described herein or known in the art) are capable of improving the ability of the anti-Galectin-9 antibody, such as any of the antibodies described herein in Table 1 and/or Table 2, for example antibody 9.2-17 or antibody 9.1-8mut13, to activate T cells (e.g., as measured by cytokine markers described herein), e.g., by 10%, 20%, 25%, 30%, 40%, 50%, 60%, 70%, 75%, 80%, 85%, 90%, 95%, or more as compared to an anti-Galectin-9 therapy alone under the same conditions. In some embodiments, the co-administered chemotherapeutic agents (e.g., as described herein or known in the art) are capable of improving the ability of the anti-Galectin-9 antibody to activate T cells (e.g., as measured by cytokine markers described herein), e.g., 1.0-1.2-fold, 1.2-1.4-fold, 1.4-1.6-fold, 1.6-1.8-fold, 1.8-2-fold, or two-fold more or more as compared to an anti-Galectin-9 therapy alone under the same conditions. In some embodiments, the co-administered chemotherapeutic agents (e.g., as described herein or known in the art) are capable of improving the ability of the anti-Galectin-9 antibody to activate T cells (e.g., as measured by cytokine markers described herein), e.g., about three-fold, four-fold, about threefold, four-fold, five-fold, six-fold, seven-fold, eight-fold, nine-fold, ten-fold, or more as compared to an anti-Galectin-9 therapy alone under the same conditions.

In some these method embodiments, wherein the administration of an anti-Galectin-9 antibody is combined with the administration of a checkpoint inhibitor, the subject has a cancer selected from the group consisting of pancreatic cancer, e.g., pancreatic ductal adenocarcinoma, cholangiocarcinoma, hepatocellular carcinoma, colorectal cancer, melanoma, renal cell carcinoma, and acute myeloid leukemia. In some embodiments, methods are provided herein, wherein the anti-Galectin-9 antibody is administered to a patient who is refractory to a previous treatment, e.g., checkpoint inhibitor therapy, such as PD-1.

In some embodiments, the disclosure provides a method for treating a cancer in a subject who is refractory to checkpoint inhibitor therapy, the method comprising administering to a subject in need thereof an effective amount of an anti-Galectin-9 antibody described herein or antigen binding fragment thereof, wherein the checkpoint inhibitor molecule is selected from the group consisting of PD-1, PD-L1, PD-L2, CTLA-4, LAG3, TIM3 and A2aR. In some embodiments, the disclosure provides a method for treating a cancer in a subject who is refractory to checkpoint inhibitor therapy, the method comprising administering to a subject in need thereof an effective amount of an anti-Galectin-9 antibody described herein or antigen binding fragment thereof, wherein the checkpoint inhibitor molecule is PD-1. In some embodiments, the cancer is selected from the group consisting of pancreatic cancer, e.g., pancreatic ductal adenocarcinoma, cholangiocarcinoma, hepatocellular carcinoma, colorectal cancer, melanoma, renal cell carcinoma, and acute myeloid leukemia. Additional useful agents can be found in, e.g., Physician's Desk Reference, 59.sup.th edition, (2005), Thomson P D R, Montvale N.J.; Gennaro et al., Eds. Remington's The Science and Practice of Pharmacy 20.sup.th edition, (2000), Lippincott Williams and Wilkins, Baltimore Md.; Braunwald et al., Eds. Harrison's Principles of Internal Medicine, 15.sup.th edition, (2001), McGraw Hill, NY; Berkow et al., Eds. The Merck Manual of Diagnosis and Therapy, (1992), Merck Research Laboratories, Rahway N.J.

It was reported that chemotherapy and/or immune therapy of solid tumors could enhance the level of immune modulators such as checkpoint molecules, resulting in suppressed immunity against tumor cells. Erisson et al., *J. Translational Medicine* (2016), 14:282; Grabosch et al., *J. Immuno-Therapy of Cancer* (2015), 3(suppl 2): P302; and Azad et al., *EMBO J.* (2016). Anti-Galectin-9 antibodies have been found to reprogram immune responses targeting tumor cells, particularly in PDA. As such, the co-use of an anti-Galectin-9 antibody and a chemotherapeutic agent (e.g., gemcitabine) or immunotherapeutic agent (e.g., anti-PD-L1 antibody) would be expected to result in significantly enhanced therapeutic activity against solid tumors, such as PDA.

In any of the described combination therapies, the additional therapeutic agent or therapy can be administered prior to, simultaneously with, or following administration of the anti-Galectin-9 antibody.

Kits for Use in Treatment of Diseases Associated with Galectin-9

The present disclosure also provides kits for use in treating or alleviating a disease associated with Galectin-9, for example associated with Galectin-9 binding to a cell surface glycoprotein (e.g., Dectin-1, TIM3, etc.), or pathologic cells (e.g., cancer cells) expressing Galectin-9. Examples include solid tumors such as PDA and others described herein, and autoimmune diseases, such as rheumatoid arthritis, systemic lupus erythematosus (SLE), autoimmune endocrine disorders, autoimmune blood disorders, and others described herein. Such kits can include one or more containers comprising an anti-Galectin-9 antibody, e.g., any of those described herein, and optionally a second therapeutic agent to be co-used with the anti-Galectin-9 antibody, which is also described herein.

In some embodiments, the kit can comprise instructions for use in accordance with any of the methods described herein. The included instructions can comprise a description of administration of the anti-Galectin-9 antibody, and optionally the second therapeutic agent, to treat, delay the onset, or alleviate a target disease as those described herein. The kit may further comprise a description of selecting an individual suitable for treatment based on identifying whether that individual has the target disease, e.g., applying the diagnostic method as described herein. In still other embodiments, the instructions comprise a description of administering an antibody to an individual at risk of the target disease.

The instructions relating to the use of an anti-Galectin-9 antibody generally include information as to dosage, dosing schedule, and route of administration for the intended treatment. The containers may be unit doses, bulk packages (e.g., multi-dose packages) or subunit doses. Instructions supplied in the kits of the invention are typically written instructions on a label or package insert (e.g., a paper sheet included in the kit), but machine-readable instructions (e.g., instructions carried on a magnetic or optical storage disk) are also acceptable.

The label or package insert indicates that the composition is used for treating, delaying the onset and/or alleviating the disease associated with Galectin-9 (e.g., Dectin-1 or TIM-3 signaling). Instructions may be provided for practicing any of the methods described herein.

The kits of this invention are in suitable packaging. Suitable packaging includes, but is not limited to, vials, bottles, jars, flexible packaging (e.g., sealed Mylar or plastic bags), and the like. Also contemplated are packages for use in combination with a specific device, such as an inhaler, nasal administration device (e.g., an atomizer) or an infusion device such as a minipump. A kit may have a sterile access port (for example the container may be an intravenous solution bag or a vial having a stopper pierceable by a hypodermic injection needle).

The container may also have a sterile access port (for example the container may be an intravenous solution bag or a vial having a stopper pierceable by a hypodermic injection needle). At least one active agent in the composition is an anti-Galectin-9 antibody as those described herein.

Kits may optionally provide additional components such as buffers and interpretive information. Normally, the kit comprises a container and a label or package insert(s) on or associated with the container. In some embodiments, the invention provides articles of manufacture comprising contents of the kits described above.

General Techniques

The practice of the present invention will employ, unless otherwise indicated, conventional techniques of molecular biology (including recombinant techniques), microbiology, cell biology, biochemistry and immunology, which are within the skill of the art. Such techniques are explained fully in the literature, such as, Molecular Cloning: A Laboratory Manual, second edition (Sambrook, et al., 1989) Cold Spring Harbor Press; Oligonucleotide Synthesis (M. J. Gait, ed., 1984); Methods in Molecular Biology, Humana Press; Cell Biology: A Laboratory Notebook (J. E. Cellis, ed., 1998) Academic Press; Animal Cell Culture (R. I. Freshney, ed., 1987); Introduction to Cell and Tissue Culture (J. P. Mather and P. E. Roberts, 1998) Plenum Press; Cell and Tissue Culture: Laboratory Procedures (A. Doyle, J. B. Griffiths, and D. G. Newell, eds., 1993-8) J. Wiley and Sons; Methods in Enzymology (Academic Press, Inc.); Handbook of Experimental Immunology (D. M. Weir and C. C. Blackwell, eds.); Gene Transfer Vectors for Mammalian Cells (J. M. Miller and M. P. Calos, eds., 1987); Current Protocols in Molecular Biology (F. M. Ausubel, et al., eds., 1987); PCR: The Polymerase Chain Reaction, (Mullis, et al., eds., 1994); Current Protocols in Immunology (J. E. Coligan et al., eds., 1991); Short Protocols in Molecular Biology (Wiley and Sons, 1999); Immunobiology (C. A. Janeway and P. Travers, 1997); Antibodies (P. Finch, 1997); Antibodies: a practical approach (D. Catty., ed., IRL Press, 1988-1989); Monoclonal antibodies: a practical approach (P. Shepherd and C. Dean, eds., Oxford University Press, 2000); Using antibodies: a laboratory manual (E. Harlow and D. Lane (Cold Spring Harbor Laboratory Press, 1999); The Antibodies (M. Zanetti and J. D. Capra, eds., Harwood Academic Publishers, 1995).

Without further elaboration, it is believed that one skilled in the art can, based on the above description, utilize the present invention to its fullest extent. The following specific embodiments are, therefore, to be construed as merely illustrative, and not limitative of the remainder of the disclosure in any way whatsoever. All publications cited herein are incorporated by reference for the purposes or subject matter referenced herein.

EXAMPLES

Example 1: Generation of Anti-Galectin-9 Antibodies

Codon-optimized genes encoding human Galectin-9 CRD1 (residues 1-148; SEQ ID NO: 3) and mouse Galectin-9 CRD1 (residues 1-147; SEQ ID NO: 5) were cloned as GST fusions using the pGEX vector including thrombin cleavage site and Avitag upstream of the cloned gene. Human Galectin-9 CRD2 (residues 218-355; SEQ ID NO: 4) and mouse Galectin-9 CRD2 (residues 226-353; SEQ ID NO: 6) were cloned into the pHBT vector, an IPTG inducible expression vector that contains a hexahistidine tag, Avitag and TEV cleavage site upstream of the cloned gene (Sha et al., *Proc Natl Acad Sci USA*, 2013, 110: 14924-14929). Human and mouse Galectin-9 CRD2 samples were then purified via Ni-Sepharose columns followed by gel filtration to apparent homogeneity and biotinylated in vitro using recombinant BirA. Human and mouse Galectin-9 CRD1 samples were purified via GST affinity chromatography followed by thrombin cleavage. Samples were further purified using gel filtration chromatography and biotinylated in a similar manner to Galectin-9 CRD2. Recombinant full-length mouse Galectin-9 (R&D Systems) was used as a control where necessary.

Antibody clones capable of binding to the human or mouse Galectin-9 fragments as noted above were isolated from a phage-display Fab library. The library follows the design of highly successful "Library E" (Miller et al., *PloS One*, 2012, 7, e43746) with improvements. A total of four rounds of phage library sorting were performed using CRD1 and CRD2 samples as the targets, essentially following published procedures (Miller et al., *PloS One*, 2012, 7, e43746; Fellouse et al., *J Mol Biol*, 2007, 373, 924-940). For CRD2, selection campaigns were performed using (a) only either mouse or human CRD2 as the target or (b) using human and mouse CRD2 samples alternately in successive rounds of library sorting. For CRD1, only human CRD1 samples were used.

Binding to Galectin-9 CRDs was determined by phage ELISA (Sidhu et al., *Methods Enzymol*, 2000, 328, 333-363). Biotinylated CRD samples were immobilized to neu-travidin-coated wells and blocked with an excess of biotin. The wells were incubated with phage displaying single Fab clones and then bound phages were detected with HRP-conjugated anti-M13 phage antibody.

Then, phage-displayed Fab clones were pre-incubated with 50 nM non-biotinylated Galectin-9 CRD2 or CRD1 prior to addition to ELISA plates. Reduction in the ELISA signal of clones with competitor compared to those without competitor indicated a high affinity and high specificity for Galectin-9 CRD1 or CRD2.

From enriched pools of antibody clones, a total of 23 clones that bind to CRD2 (FIGS. 1A-1B) and a total of 11 clones to CRD1 (FIGS. 2A-2B) were identified. Their amino acid sequences were deduced by determining the DNA sequences of the Fab genes in the phage clones (which are provided herein as SEQ ID NO: 7-75 and 77-85).

The genes for a subset of identified antibody clones were transferred into an *E. coli* expression vector that has previously been described (Zhang et al., *Proc Natl Acad Sci USA*, 2012, 109, 8534-8539). Fab proteins were expressed in *E. coli* BL21 (EMD Millipore) and purified using HiTrap Protein G HP column (GE Healthcare) as described (Hattori et al., *Nat Methods*, 2013, 10, 992-995) followed by Superdex S200 or ResourceS column (GE Healthcare). When required, purified Fab was biotinylated via the Avitag attached to the C-terminus of the heavy chain using BirA.

Antibodies in the human IgG1, human IgG4, mouse IgG1 and mouse IgG2a formats were produced by cloning the genes for the $V_H$ and $V_L$ regions into mammalian expression vectors for IgG production (Invivogen). Accordingly, mIgG1 and mIgG2a are human/mouse hybrids, because the Fc (i.e. CH2 and CH2) is mouse IgG1, whereas CH1 and CL are human. The proteins were produced by transient transfection of ExpiCHO cells (ThermoFisher) and purified using Protein G Sepharose chromatography followed by Superdex S200 or ResourceS chromatography (GE Healthcare).

Example 2: Characterization of Anti-Galectin-9 Antibody Clones

Epitope Binning

Figure 1B:
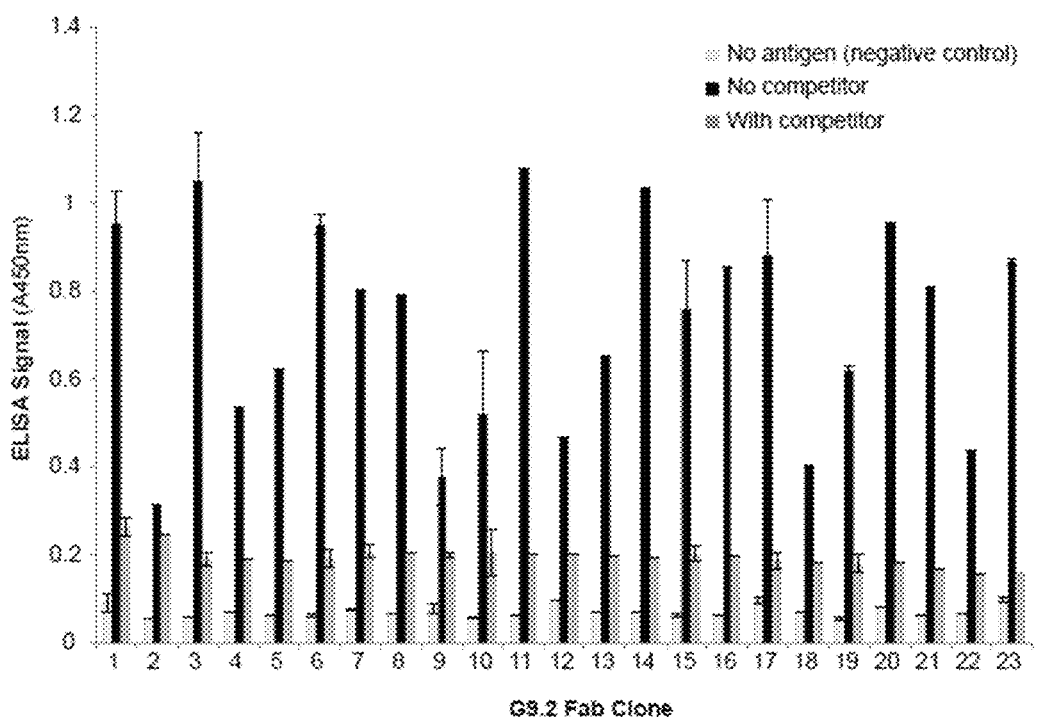
Figure 3A:
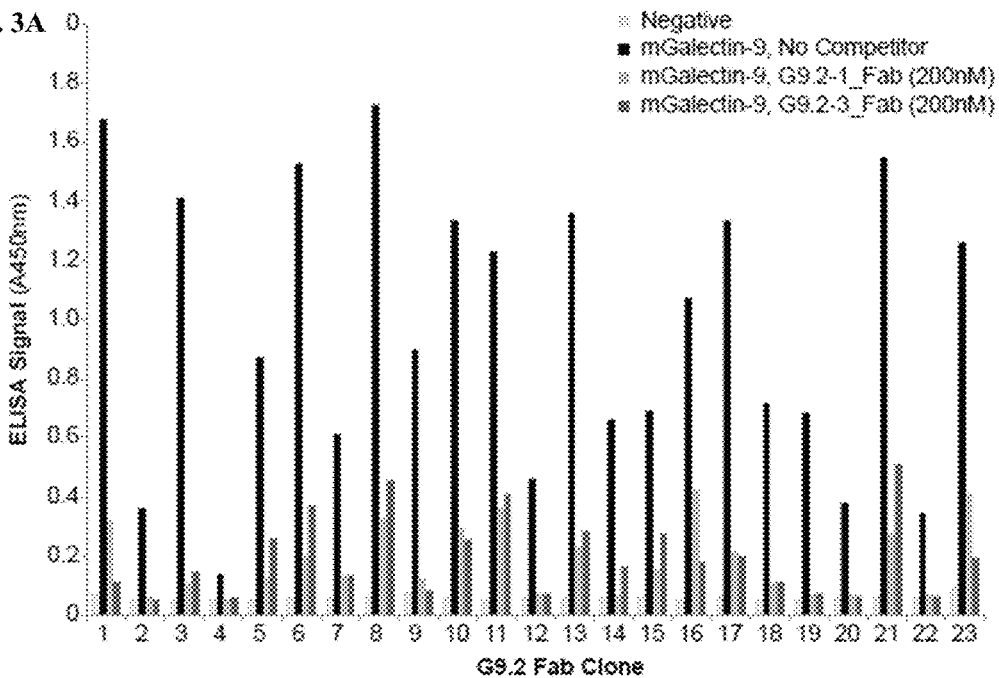
FIGS. 3A-3B include charts showing epitope binning of G.9-2 Fab clones (binding to CRD2) using competition phage ELISA.
Figure 3B:
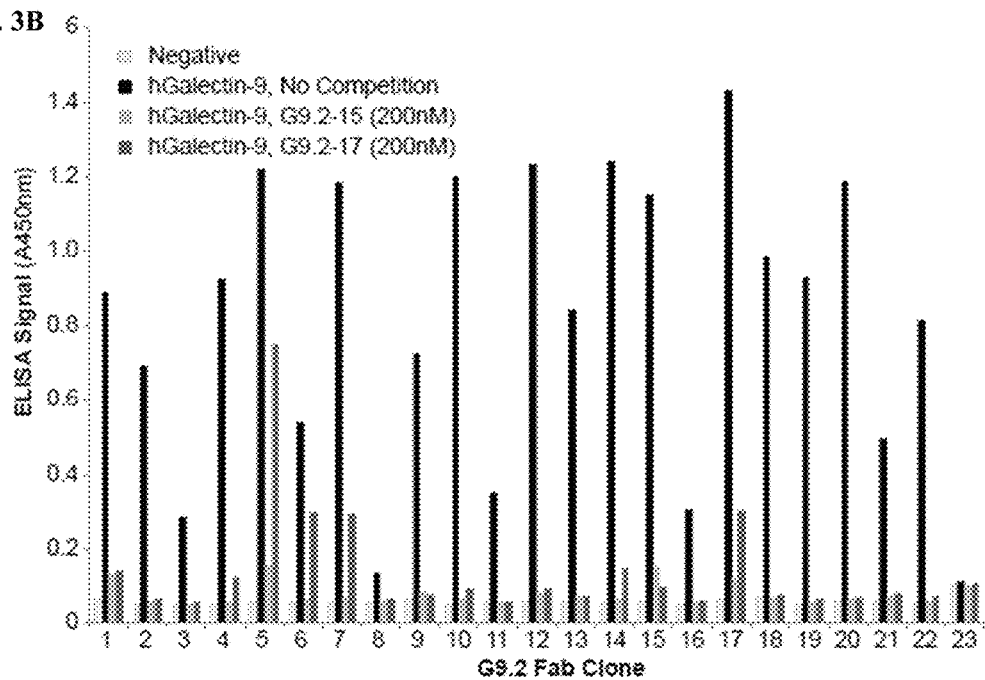

Whether the antibody clones bind to distinct (non-overlapping) epitopes in Galectin-9 was examined using competition phage ELISA. The binding of all the CRD2-binding clones were significantly inhibited by pre-incubation of the purified G9.2-1, G9.2-3, G9.2-15 or G9.2-17 Fab clone (FIGS. 3A-3B), indicating that the isolated clones bind to an overlapping epitope within CRD2. Clones G9.2-15 and G9.2-17 were selected as representative clones for further characterization because of their strong binding activity and good cross-reactivity between human and mouse Galectin-9 (FIGS. 1A-1B).

Epitope Mapping

Figure 10A:
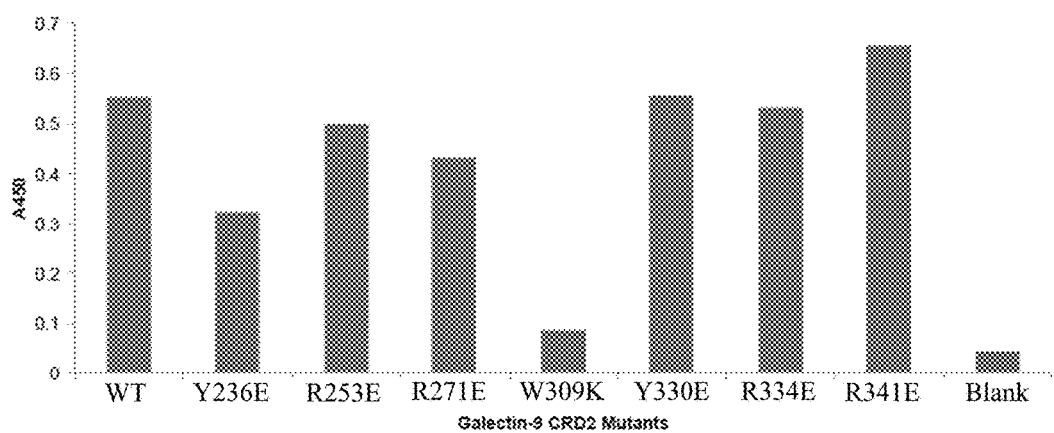
FIGS. 10A-10B include diagrams showing epitope mapping of G.9-2.17 on human Galectin-9 CRD2 by systematic mutagenesis.
Figure 10B:
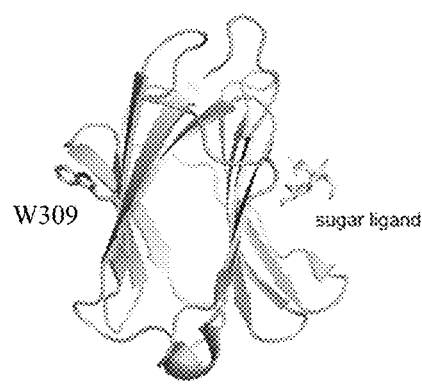

The G9.2-17 clone was selected for further epitope analysis. To determine its epitope on Galectin-9 CRD2, a series of point mutants were constructed. Their ability to bind to G9.2-17 was assayed using phage ELISA, as shown in FIG. 10A. Reductions in ELISA signal indicates sites on Galectin-9 CRD2 that are critical to G9.2-17 binding. Notably, the W309K mutation (residue numbering is according to isoform 1, NCBI GenBank Accession No. BAB83625.1) dramatically reduced the binding, while the other mutations had marginal effects, suggesting that G9.2-17 binds to a region including W309. Crystal structure analysis of the region showed that it is located opposite the sugar-binding site (FIG. 10B). The term "W309" or "residue W309" refers to the tryptophan residue found at position 309 in SEQ ID NO:

1 (Galectin-9) or to the tryptophan residue located at position 277 in the sequence of Galectin-9 isoform 2, UniProt ID 000182-2 or to a residue in CRD2 of Galectin-9 that corresponds to the residue found at position 309 in SEQ ID NO: 1 or at position 277 in the sequence of the isoform of UniProt ID 000182-2. The terms "R253", "R271", "R334", and "R341" refer to the arginine residue found at positions 253, 271, 334, and 341, respectively, in SEQ ID NO: 1 or the arginine residue found at positions 221, 239, 302, 309, respectively, in the sequence of Galectin-9 isoform 2, UniProt ID 000182-2. The terms "Y330" and "Y236" refer to the tyrosine residue found at positions 330 and 236, respectively, in SEQ ID NO: 1 or the tyrosine residue found at positions 298 and 204, respectively, in the sequence of Galectin-9 isoform 2, UniProt ID 000182-2.

Figure 11:
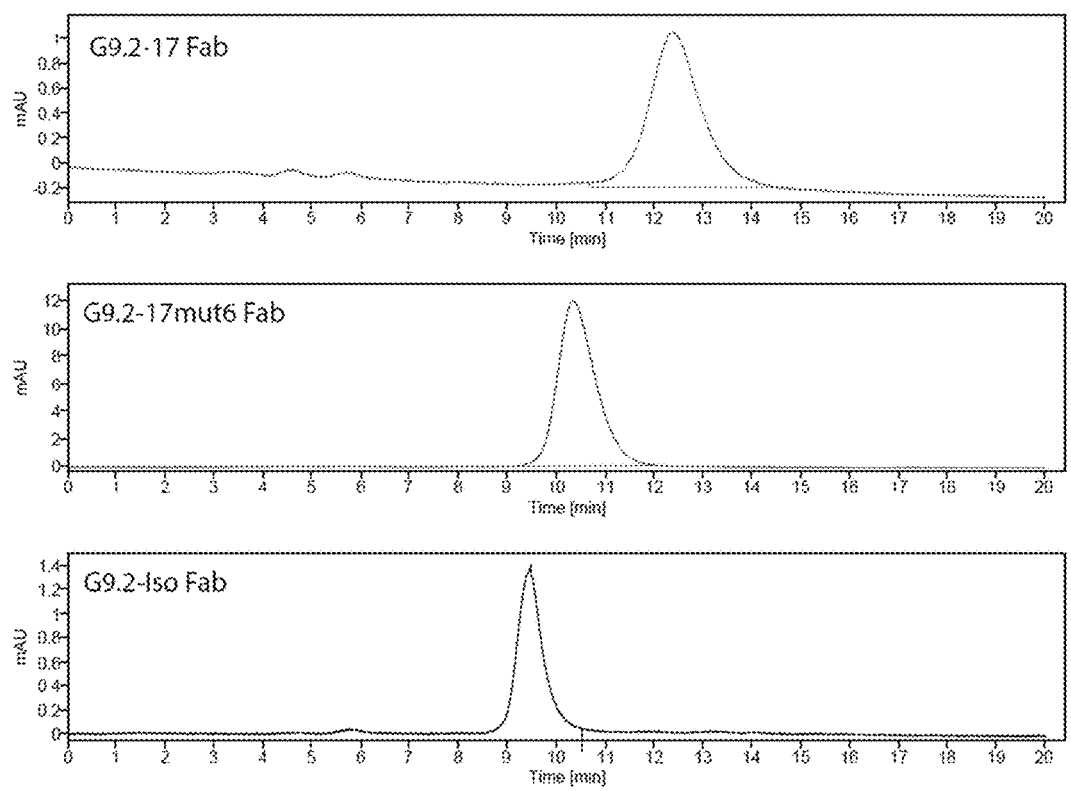
FIG. 11 contains charts showing size-exclusion chromatography analyses of Fab G9.2-17 (top), Fab G9.2-17mut6 (middle) and Fab G9.2-Iso (bottom). Purified Fab samples were run on TOSOH TSK Bioassist G2WXL Column in PBS and detected using absorbance at 280 nm.
Figure 12:
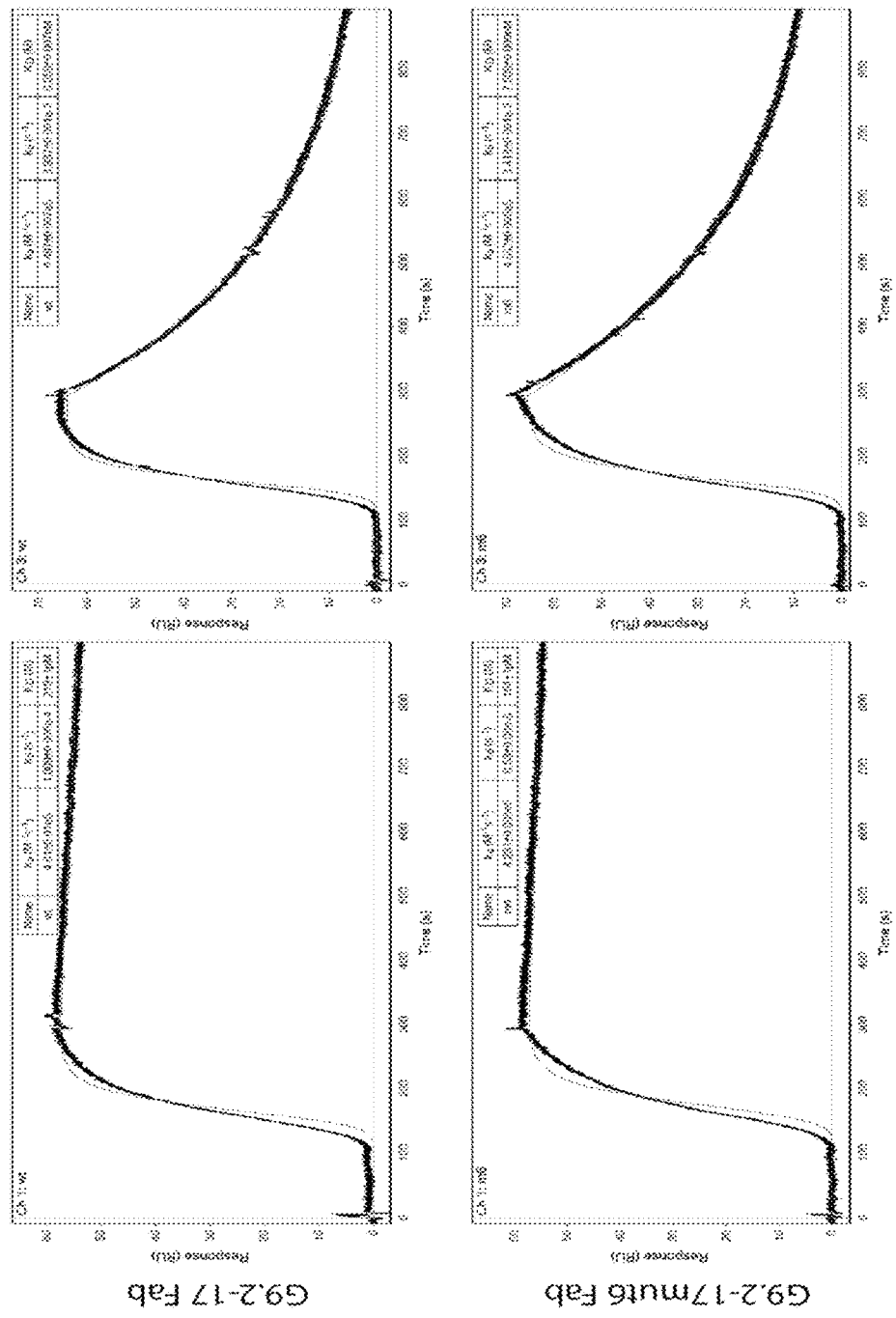
FIG. 12 contains charts showing surface plasmon resonance analyses of Fab G9.2-17 (top) and Fab G9.2.17mut6 (bottom) binding to the CRD2 of human (left) and mouse (right) Galectin-9. Human or mouse Galectin-9 CRD2 was immobilized on an Avicap chip preloaded with neutravidin on a Pall ForteBio Pioneer instrument. Fab samples were then flowed using the OneStep method. The binding and dissociation phases of the experiments are marked in the top panels.

Mutation that Suppresses the Interaction of G9.2-17 Fab with Chromatography Matrix Purified antibody (Fab or IgG) samples were run on TOSOH TSKgel Bioassist G2WXL columns in PBS and detected using absorbance at 280 nm. The Fab sample of G9.2-17 was found to exhibit a longer retention time than expected for its size, suggesting it interacts with the chromatography column material (FIG. 11). In comparison, the Fab sample of G9.2-Iso eluted with the expected time. A point mutant of G9.2-17, termed G9.2.17mut6, was found to have an improved chromatography profile while retaining the affinity to human and mouse Galectin-9 CRD2 (FIG. 12), suggesting that this mutant has a reduced level of off-target binding.

Antibodies that Bind to a Distinct Epitope within CRD2

Figure 13:
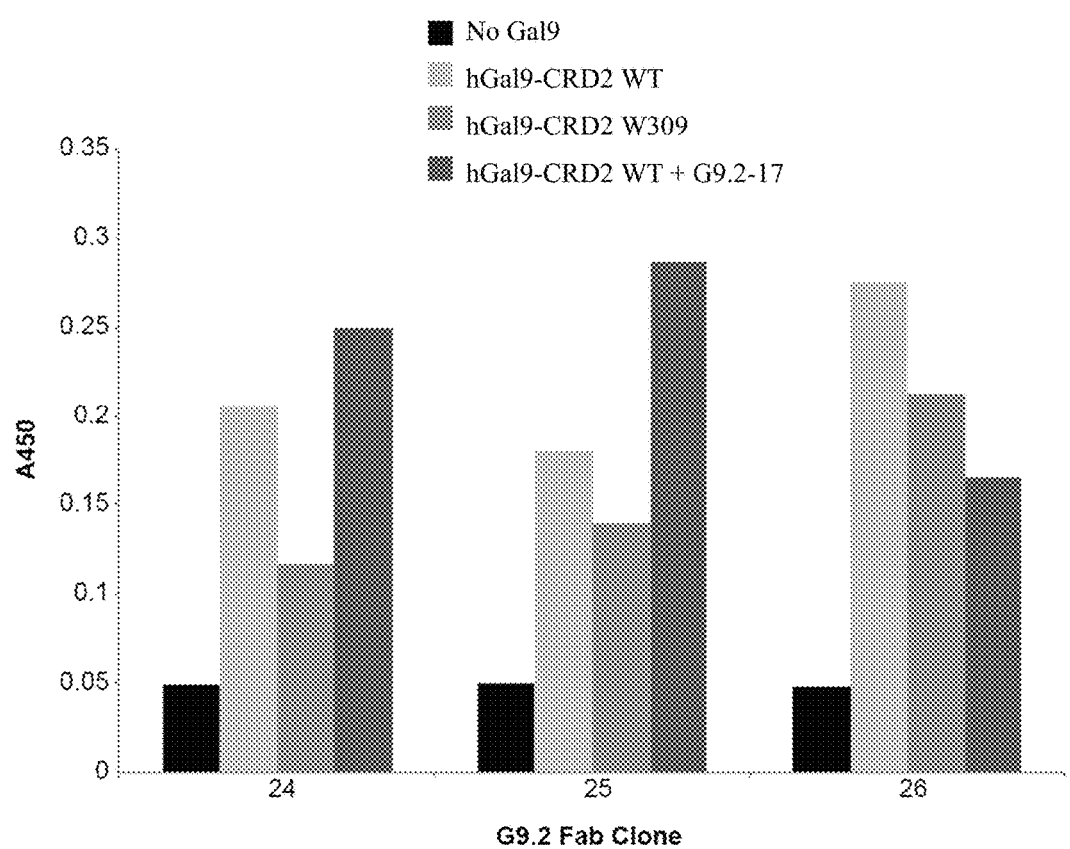
FIG. 13 is a graph showing a binding characterization of G9.2 Fab clone for wild-type Galectin-9 CRD2 or the W3039K mutant using phage ELISA. Binding of Fab clones to human Galectin-9 CRD2 assayed using phage ELISA. Either biotinylated wild type human Galectin-9 CRD2, the W309K Galectin-9 CRD2 mutant, or Galectin-9 CRD2 pre-incubated with G9.2-17 IgG was immobilized to neutravidin-coated wells and incubated with individual phage-displayed Fab clones.
Figure 14:
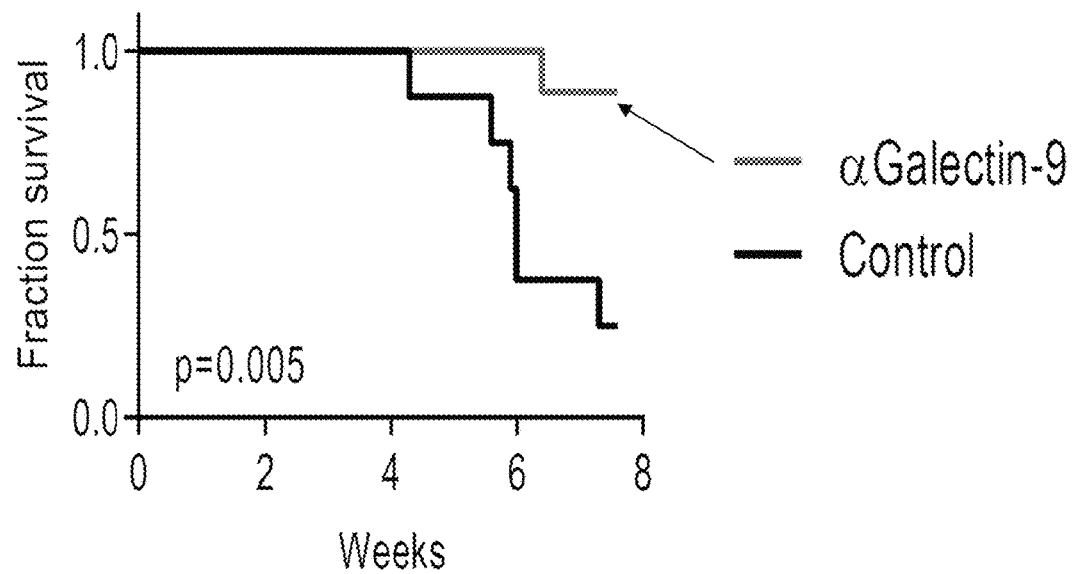
FIG. 14 is a Kaplan-Meier plot showing that blocking Galectin-9 results in significant extension of survival in animal models of pancreatic cancer (KPC mice).
Figure 15:
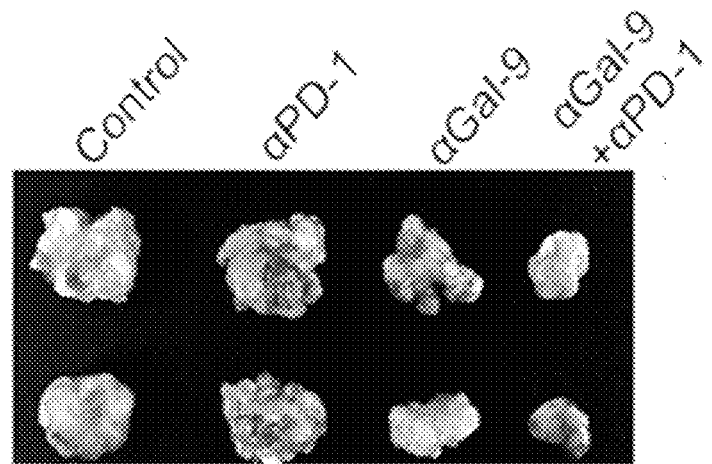
FIG. 15 is a photograph of mouse tumors showing that blocking galectin-9 and anti-PD1 generates a superior response.
Figure 16:
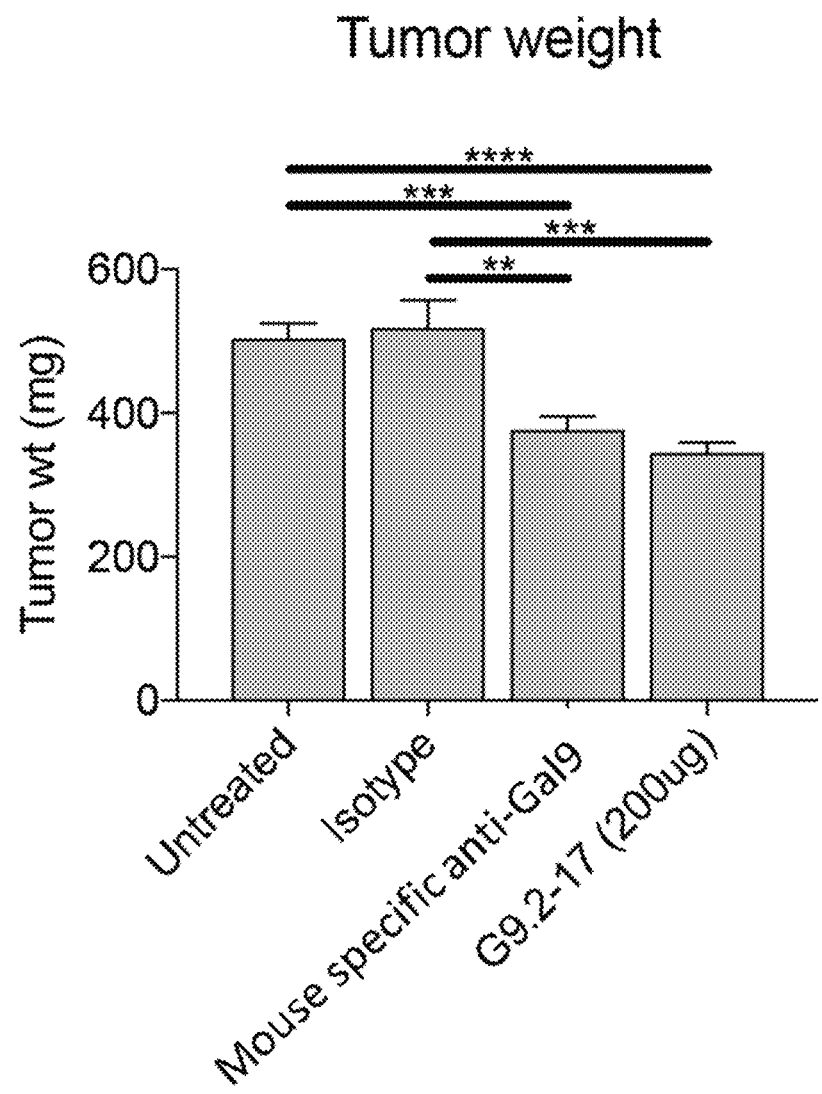
FIG. 16 is a bar graph showing the tumor mass of mice treated with G9.2-17 mIgG1. Mice (n=10/group) with orthotopically implanted KPC tumors were treated with commercial isotype (200 µg) or commercial αGal9 (200 µg) mAb or G9.2-Iso mIgG1 (200 µg) or G9.2-17 mIgG1 at two doses (200 µg or 400 µg) once weekly for three weeks. Tumors were removed and weighed, and subsequently processed and stained for flow cytometry.

Potential additional epitopes were explored using additional clones that bind to Galectin-9 CRD2. A phage display library selection using a modified scheme so as to enrich clones that bind to an epitope that is distinct from that of G9.2-17 was performed. Wild type human biotinylated Galectin-9 CRD2, the W309K Galectin-9 CRD2 mutant, or Galectin-9 CRD2 preincubated with G9.2-17 IgG was immobilized to neutravidin-coated wells and incubated with individual phage-displayed Fab clones. The results are shown in FIG. 13. Three clones (G9.2-24, G9.2-25, and G9.2-26) exhibited similar levels of binding to the three targets tested, wild-type Galectin-9 CRD2, the W309K mutant, and wild-type CRD2 in complex with G9.2-17. Their binding profiles suggest that they bind to an epitope that is distinct from that of G9.2-17.

Affinity Measurements

The affinities of the antibodies were assessed using a bead-based assay as previously described (Nishikori et al., *J Mol Biol*, 2012, 424, 391-399) and surface plasmon resonance (SPR). In the bead-based assay, a biotinylated protein (either a Galectin-9 sample or a Fab sample) was immobilized on streptavidin-coated Dynabeads M280 via the biotin-streptavidin interaction. After blocking the excess biotin-binding sites on the beads using unconjugated biotin, binding titration was performed by incubating the second component (i.e., Fab for immobilized Galectin-9 or vice versa), followed by quantification using a dye-labeled neutravidin (ThermoFisher) and flow cytometry analysis. The results obtained from this experiment are provided in FIGS. 4 and 5. In experiments where the second component is an IgG, a dye-labeled anti-human IgG or anti-mouse IgG antibody was used for detection.

In SPR experiments, a biotinylated Galectin-9 sample was immobilized on an Avicap chip (Pall ForteBio) that had been preloaded with neutravidin (ThermoFisher). Antibody samples were flowed using the OneStep method on a Pioneer SPR instrument (Pall ForteBio) and the results are provided in FIG. 6.

Figure 4:
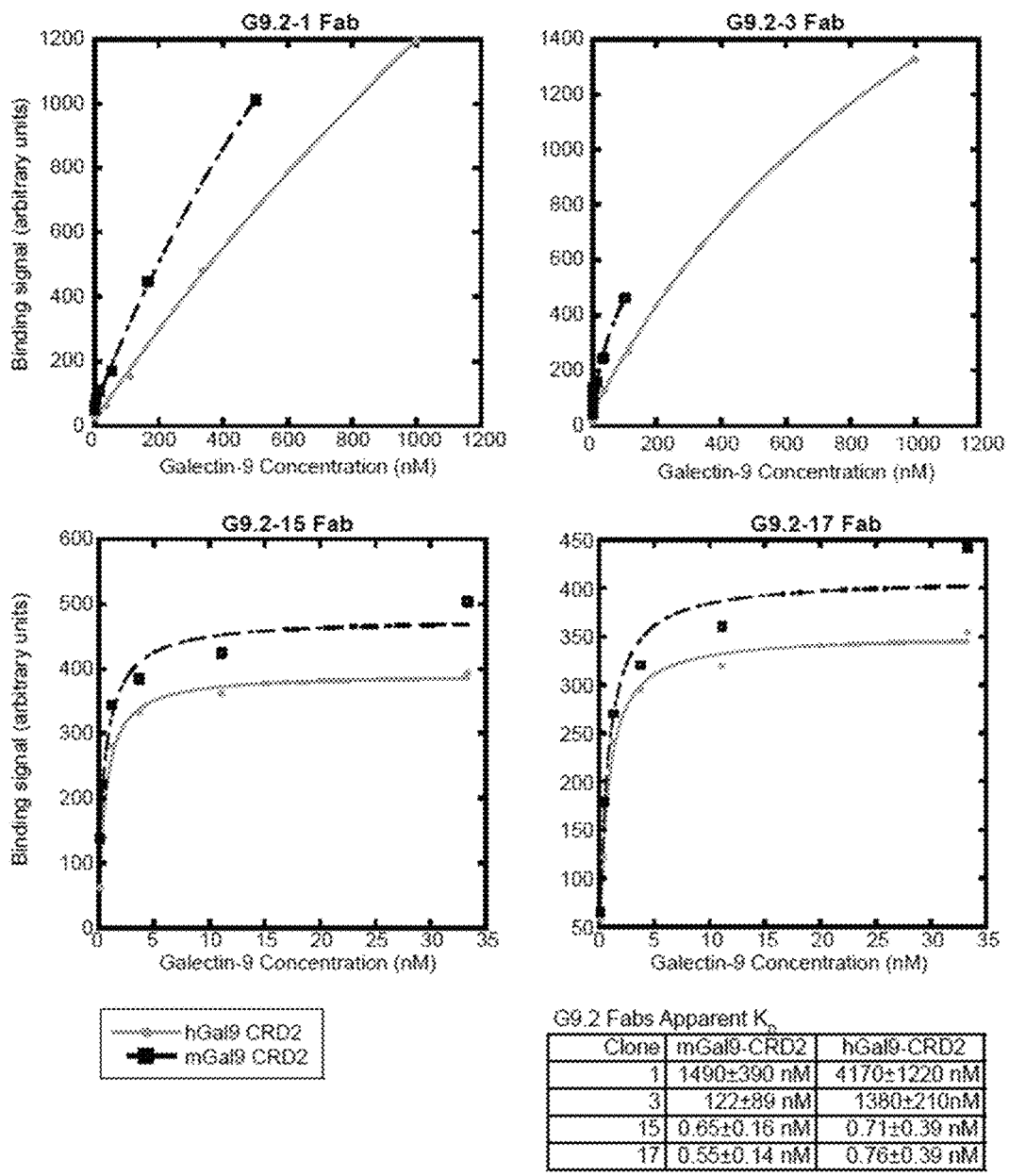
FIG. 4 includes diagrams showing the affinity of purified G9.2 Fabs to Galectin-9 CRD2, characterized using a bead-based binding assay. The curves show the best fit of the one-to-one binding model. Top left: G9.2-1 Fab. Top right: G9.2-3 Fab. Bottom left: G9.2-15 Fab. Bottom right: G9.2-17 Fab. Apparent Kd values are shown in the table.
Figure 5:
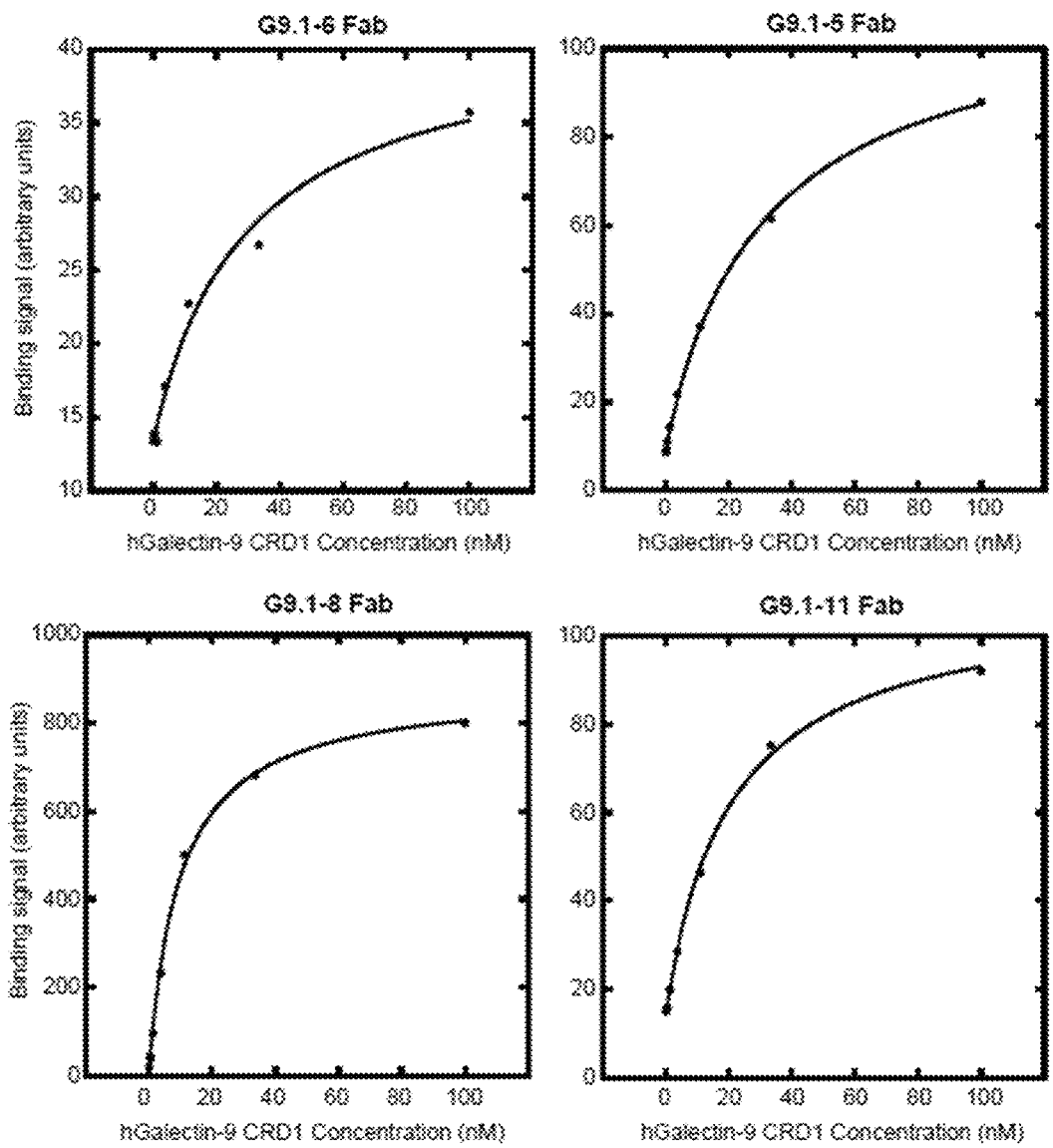
FIG. 5 includes diagrams showing the affinity of purified G9.1 Fabs to Galectin-9 CRD1, characterized using a bead-based binding assay. Experiments were performed in the same manner as in FIG. 4. Top left: G9.1-6 Fab. Top right: G9.1-5 Fab. Bottom left: G9.1-8 Fab. Bottom right: G9.1-11 Fab. Apparent Kd values are shown in the table.
Figure 6:
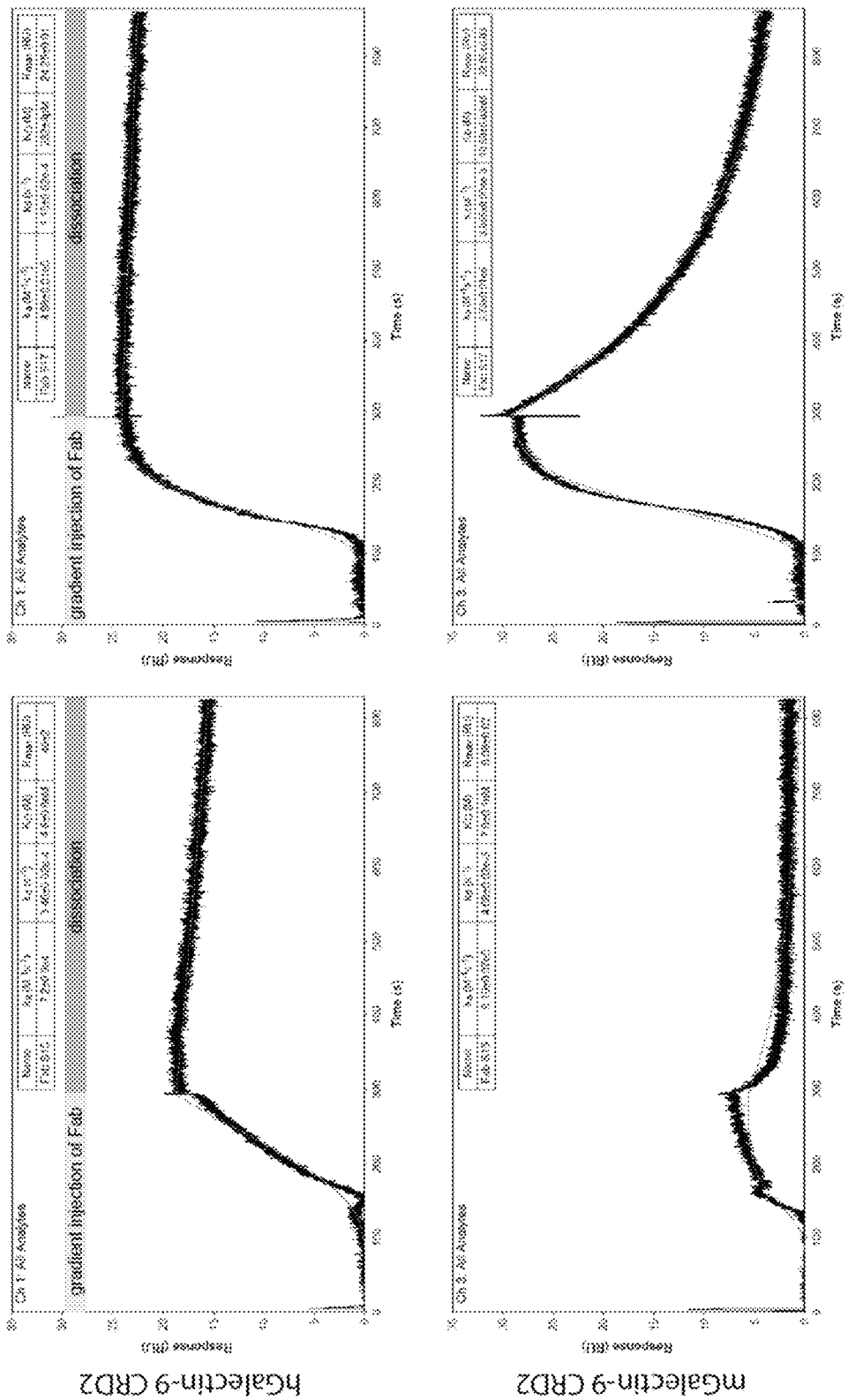
FIG. 6 includes diagrams showing a surface plasmon resonance analysis of Fab G9.2-15 and Fab G9.2-17 binding to CRD2 of human (top) and mouse (bottom) Galectin-9. The binding and dissociation phases of the experiments are marked in the top panels. Left: G9.2-15 Fab. Right: G9.2-17 Fab.

The above-noted two assays revealed that the analyzed Fab samples had dissociation constant ($K_D$) values in the low or sub nanomolar range to their respective targets, as provided in FIGS. 4-6.

Conversion of G9.2-17 into the human IgG4 format substantially reduced the dissociation rate, as expected from the bivalent nature of IgG4 (FIG. 7). This was demonstrated using the OneStep method described above.

Detection of Endogenous Galectin-9 on Cells

Figure 8:
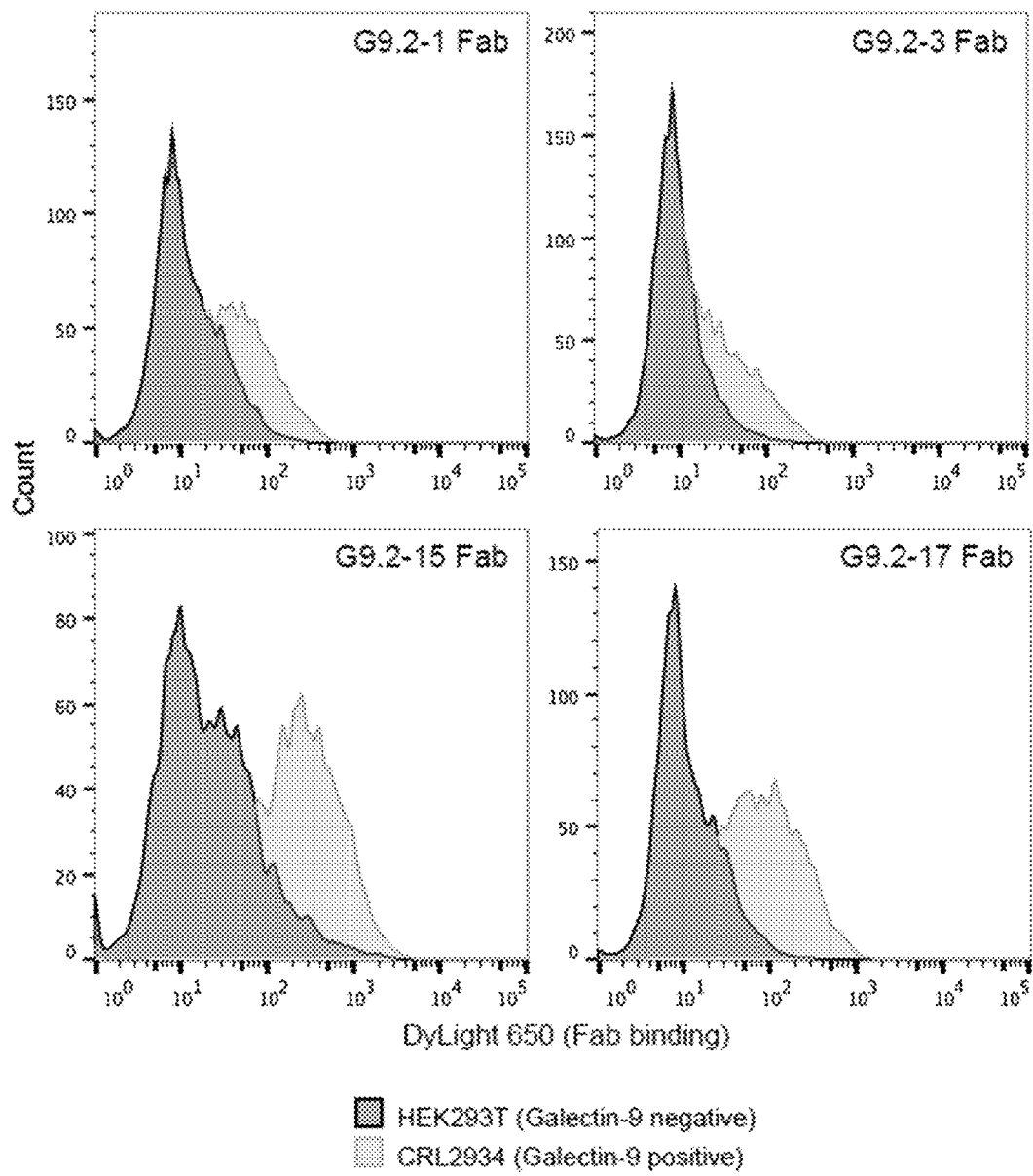
FIG. 8 includes diagrams showing the staining of cell line samples with Fabs for Galectin-9 CRD2. Histograms for flow cytometry data are shown. Top left: G9.2-1 Fab. Top right: G9.2-3 Fab. Bottom left: G9.2-15 Fab. Bottom right: G9.2-17 Fab.

To confirm that the antibodies bind to endogenous Galectin-9 produced in human cells, HEK293T and CRL-2134 cell lines were incubated with a biotinylated Fab, and bound Fab was detected using neutravidin conjugated with DyLight 650. Samples were then analyzed using flow cytometry. Strong signals were observed for CRL-2134 that expresses Galectin-9 but not for HEK293T that does not express Galectin-9 (Lahm et al., *J Cancer Res Clin Oncol*, 2001, 127, 375-386) (FIG. 8).

Figure 9:
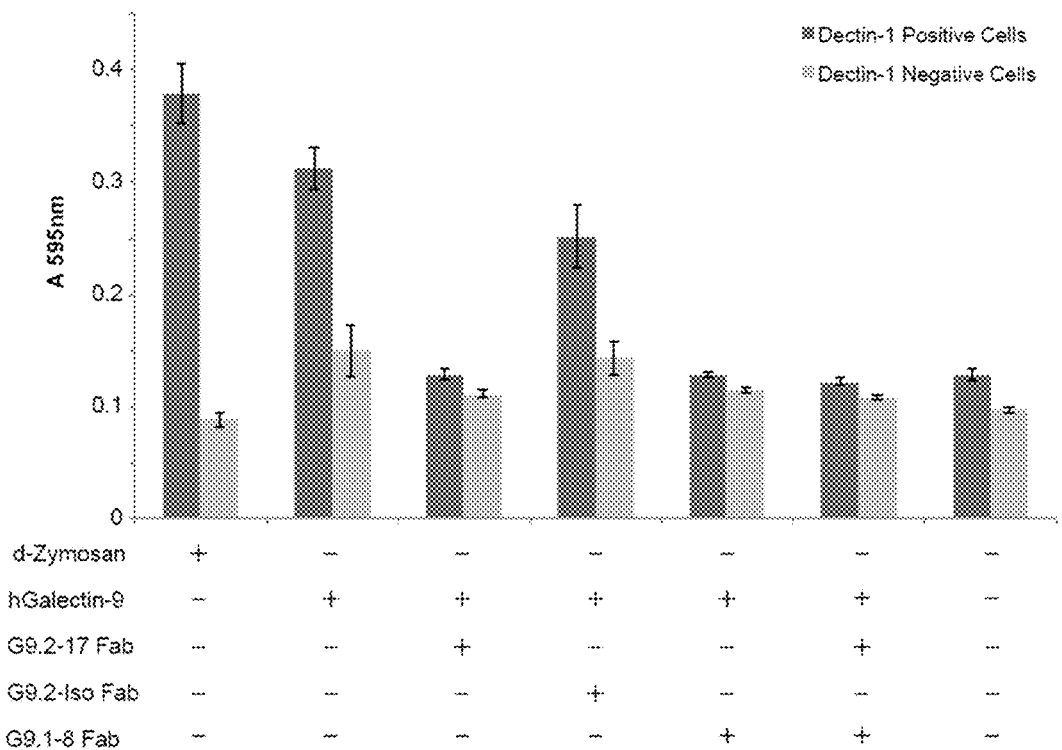
FIG. 9 is a chart showing the inhibitory effects of G9.2-17 and G9.1-8 on Galectin-9 mediated activation of Dectin-1 signaling.

The data demonstrates that these antibodies recognize endogenous Galectin-9 and also show that they have minimal cross-reactivity for other cell surface proteins. To measure antibody binding to endogenous Galectin-9 produced in human cells, CRL-2134 cells were stained using varying concentrations of anti-Galectin-9 antibody or a negative control. Samples were then washed and bound antibodies were detected using anti-Mouse IgG conjugated to Dylight 650 (Invitrogen, Carlsbad, Calif.). Prior to flow cytometry analysis, propidium iodide (1 µg/mL) was added to each sample. Samples were then analyzed using flow cytometry. Percentage of galectin-9 positive cells was determined using unstained cells as a negative control. Cell-based dissociation constant ($K_D$) was calculated from a saturation curve generated based on percentage of galectin-9 positive cells as a function of antibody concentration and the 1:1 binding model Inhibition of Galectin-9-Mediated Activation of Dectin-1 Signaling Using a reporter cell line for human Dectin-1 signaling (Invivogen), the effects of the anti-Galectin-9 antibodies on the signaling activation mediated by Galectin-9 were examined. In this assay, activation of the Dectin-1 signaling pathway leads to the secretion of alkaline phosphatase into the cell media, which is detected as quantifiable colorimetric changes. Cell lines were incubated with the indicated molecules for 16 hours. In the absence of an antibody, Galectin-9 (R&D Systems) robustly activated the reporter on par with depleted zymosan, a known ligand for Dectin-1, as shown in FIG. 9. As expected, Galectin-9 exhibited no activation on the matched cell line that did not express Dectin-1.

The antibodies inhibited the activation effect of Galectin-9, suggesting that they block the interaction of Galectin-9 with Dectin-1 on the cell surface.

Example 3: Evaluation of Anti-Gal-9 Antibodies in a Mouse Model of Ductal Adenocarcinoma (PDA)

To test the effect of treatment with an anti-Gal9 antibody to pancreatic ductal adenocarcinoma (PDA), two PDA mouse models can be used: the slowly progressive PDA model p48Cre;LSL-KrasG12D (KC) in which mice express oncogenic Kras in their pancreatic progenitor cells, and a more aggressive orthotopic PDA model utilizing tumor cells from Pdx1Cre;LSL-KrasG12D;Tp53R172H (KPC) mice, which expresses mutant Kras and p53; as well as in human PDA42,43. A combination of immunohistochemical analysis, flow cytometry, or immune-fluorescent microscopy can be used to conduct immune profiling and assess the effect of treatment with anti-galectin antibodies as compared to isotype controls. Similar techniques are used to study human samples derived from PDA patients.

In one example of a mouse study, six week-old KC mice are treated with the anti-galectin antibody, e.g., G9.2-17, to test the ability of anti-galectin antibody to reduce or prevent tumor growth. Tumor progression is assessed, one, two, three, four, five, six, seven, and eight weeks later compared to vehicle-treated animals. Animals are sacrificed and acinar architecture in the pancreata is assessed and scored. Immune profiling is performed according to FACS methods known in the art.

Example 4: Spheroid Preparation and Microfluidic Culture of Patient Tumor Samples Fresh tumor specimens (human patients) are received in media (DMEM) on ice and minced in a 10-cm dish (on ice) using sterile forceps and scalpel. Minced tumor is resuspended in DMEM (4.5 mmol/L glucose, 100 mmol/L Na pyruvate, 1:100 penicillin-streptomycin; Corning CellGro)+ 10% FBS (Gemini Bio-Products), 100 U/mL collagenase type IV (Life Technologies), and 15 mmol/L HEPES (Life Technologies). Samples are pelleted and resuspended in 10 to 20 mL media. Red blood cells (RBC) are removed from visibly bloody samples using RBC lysis buffer (Boston Bio-Products). Samples are pelleted and then resuspended in fresh DMEM+10% FBS and strained over 100-μm filter and 40-μm filters to generate 51 (>100 μm), S2 (40-100 μm), and S3 (<40 μm) spheroid fractions, which are subsequently maintained in ultralow-attachment tissue culture plates. S2 fractions are used for ex vivo culture. An aliquot of the S2 fraction is pelleted and resuspended in type I rat tail collagen (Corning) at a concentration of 2.5 mg/mL following the addition of 10×PBS with phenol red with pH adjusted using NaOH. pH 7.0-7.5 is confirmed using PANPEHA Whatman paper (Sigma-Aldrich). The spheroid-collagen mixture is then injected into the center gel region of a 3-D microfluidic culture device as described in Jenkins et al., Cancer Discov. 2018 February; 8(2):196-215; Ex Vivo Profiling of PD-1 Blockade Using Organotypic Tumor Spheroids, the contents of which is herein incorporated by reference in its entirety. Collagen hydrogels containing patient-derived organotypic tumor spheroids (PDOTS) are hydrated with media with or without anti-Gal-9 monoclonal antibodies after 30 minutes at 37° C.

In some cases, to test synergy with checkpoint inhibitors or other immunotherapy agents, PDOTS are treated with anti-PD-1 (pembrolizumab, 250 μg/mL), anti-CTLA4 (ipilimumab, 50 μg/mL), or combination (250 μg/mL pembrolizumab+50 μg/mL ipilimumab). For indicated PDOTS studies, anti-human PD-L1 (atezolizumab at 600 μg/mL+ human IFNgamma. Immune profiling is performed by flow cytometry as described in Jenkins et al.

Example 5: Generation and Analysis of Variants of Clone G9.1-8

Mutants of clone G9.1-8 were designed by replacing CDR residues with Ser or by truncation of the CDR regions. The mutant genes were constructed using standard site-directed mutagenesis methods and produced as described in Example 1. A total of 14 mutants were designated as G9.1-8m1-G9.1-8m1 (see Table 4-9). G9.1-8m1 and G9.1-8m2 have mutations to CDR-H2. G9.1-8m3, G9.1-8m4 and G9.1-8m5 mutations to CDR-H3. G9.1-8m6, G9.1-8m7, G9.1-8m8, G9.1-8m8, G9.1-8m10, and G9.1-8m11 have truncations to CDR-H3. G9.1-8m12, G9.1-8m13, and G9.1-8m14 have mutations in CDR-H2 and CDR-H3. G9.1-8m12 comprises a combination of G9.1-8m2 and G9.1-8m8 mutations; G9.1-8m13 comprises a combination of G9.1-8m2 and G9.1-8m9 mutations; G9.1-m14 comprises a combination of G9.1-8m2 and G9.1-8m11 mutations.

TABLE 4

Light and Heavy Chain Sequences for G9.1-8 mutants

| Clone Name | Light chain SEQ ID | Heavy Chain SEQ ID |
|---|---|---|
| G9.1-8m1 | 21 | 74 |
| G9.1-8m2 | 21 | 75 |
| G9.1-8m3 | 21 | 76 |
| G9.1-8m4 | 21 | 77 |
| G9.1-8m5 | 21 | 78 |
| G9.1-8m6 | 21 | 79 |
| G9.1-8m7 | 21 | 80 |
| G9.1-8m8 | 21 | 81 |
| G9.1-8m9 | 21 | 82 |
| G9.1-8m10 | 21 | 83 |
| G9.1-8m11 | 21 | 84 |
| G9.1-8m12 | 21 | 85 |
| G9.1-8m13 | 21 | 86 |
| G9.1-8m14 | 21 | 87 |

FIGS. 18-22 depict graphs showing binding data for these clones as measured using the bead binding assay as described in Example 2. Table 5-Table XXX list the KD for various clones. As described above, antibodies mouse IgG1 and mouse IgG2a formats were produced by cloning the genes for the $V_H$ and $V_L$ regions into mammalian expression vectors for IgG production (Invivogen).

TABLE 5

Binding of purified G9.1-8 mutant mIgG1 clones as characterized using a bead-based binding assay

| Clone Designation | KD (nM) |
|---|---|
| G9.1-8 WT mIgG1 | 2.4 ± 1.1 |
| G9.1-8m2 mIgG1 | 6.51 ± 0.65 |
| G9.1-8m4 mIgG1 | 12.0 ± 4.2 |
| G9.1-8m1 mIgG1 | no detectable binding |
| G9.1-8m3 mIgG1 | no detectable binding |
| G9.1-8m5 mIgG1 | no detectable binding |

TABLE 6

Binding of purified G9.1-8 mutant Fab as characterized using a bead-based binding assay

| Clone Designation | KD (nM) |
|---|---|
| G9.1-8 WT Fab | 0.45 ± 0.03 |
| G9.1-8m6 Fab | 0.52 ± 0.05 |
| G9.1-8m7 Fab | 0.93 ± 0.05 |
| G9.1-8m8 Fab | 0.56 ± 0.04 |
| G9.1-8m9 Fab | 1.57 ± 0.16 |
| G9.1-8m10 Fab | 58.4 ± 3.4 |
| G9.1-8m11 Fab | 52.7 ± 8.8 |

TABLE 7

Binding of purified G9.1-8 mutant mIgG2a as characterized using a bead-based binding assay

| Clone Designation | KD (nM) |
| --- | --- |
| G9.1-8m8 mIgG2a | 0.51 ± 0.05 |
| G9.1-8m9 mIgG2a | 0.71 ± 0.04 |
| G9.1-8m11 mIgG2a | 1.46 ± 0.05 |

TABLE 8

Binding of purified G9.1-8 mutant Fab as characterized using a bead-based binding assay

| Clone Designation | KD (nM) |
| --- | --- |
| G9.1-8 WT Fab | 2.13 ± 0.13 |
| G9.1-8m12 Fab | 2.48 ± 0.21 |
| G9.1-8m13 Fab | 20.7 ± 0.8 |
| G9.1-8m14 Fab | 58.5 ± 7.7 |

TABLE 9

Binding of purified G9.1-8 mutant mIgG2a as characterized using a bead-based binding assay

| Clone Designation | KD (nM) |
| --- | --- |
| G9.1-8 WT mIgG1 | 0.63 ± 0.07 |
| G9.1-8m12 mIgG2a | 0.32 ± 0.04 |
| G9.1-8m13 mIgG2a | 0.30 ± 0.04 |
| G9.1-8m14 mIgG2a | 2.01 ± 0.11 |

Figure 25:
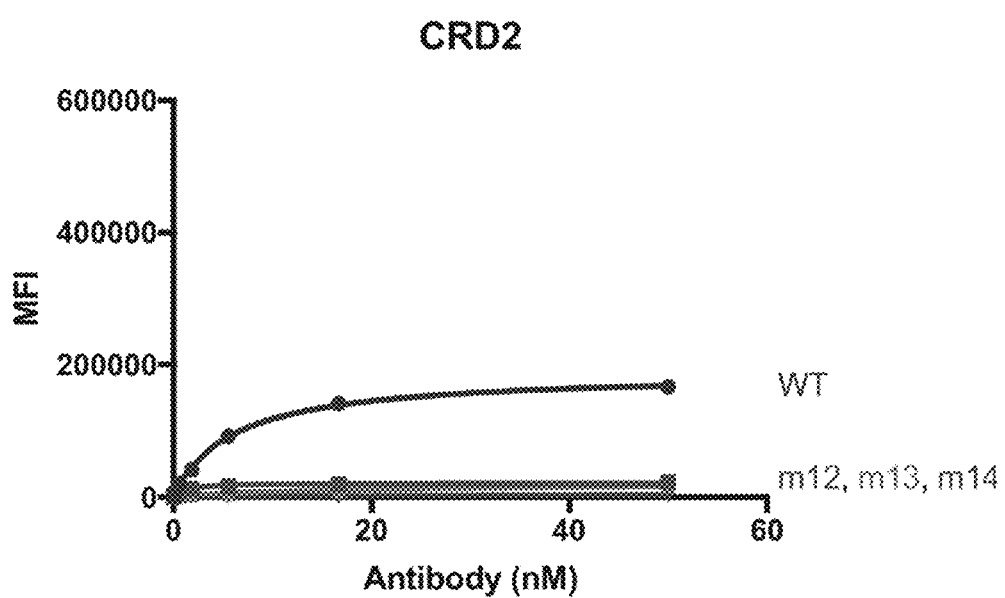
FIG. 25 depicts a line graph showing binding of purified G9.1-8m12-14 mIgG2a antibodies to human Galectin-9 CRD2 as compared to G9.18 (WT) as characterized using a bead-based binding assay.
Figure 26A:
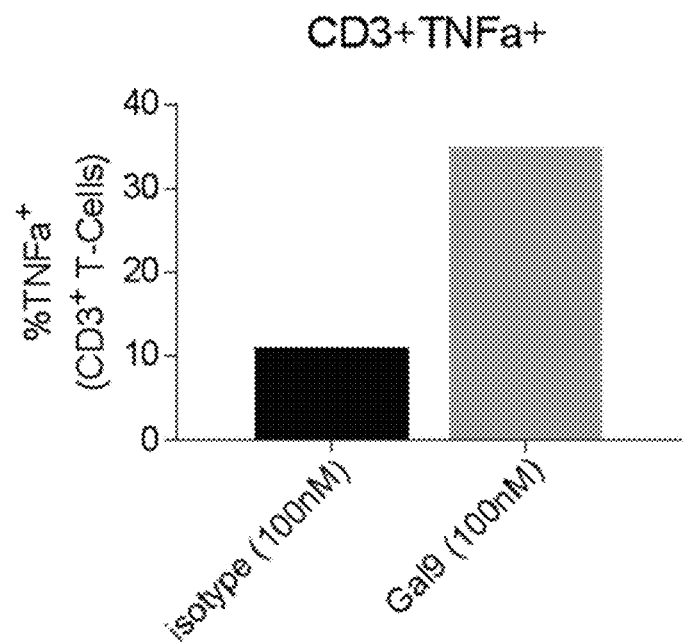
FIGS. 26A and 26B depict bar graphs showing TNF-alpha (FIG. 26A) and IFNgamma (FIG. 26B) expression in CD3+ T cells in pancreatic adenocarcinoma primary tumor sample patient-derived organotypic tumor spheroids (PDOTs) treated with 9.2-17 IgG4 (100 nM) as compared to isotype control (100 nM).
Figure 26B:
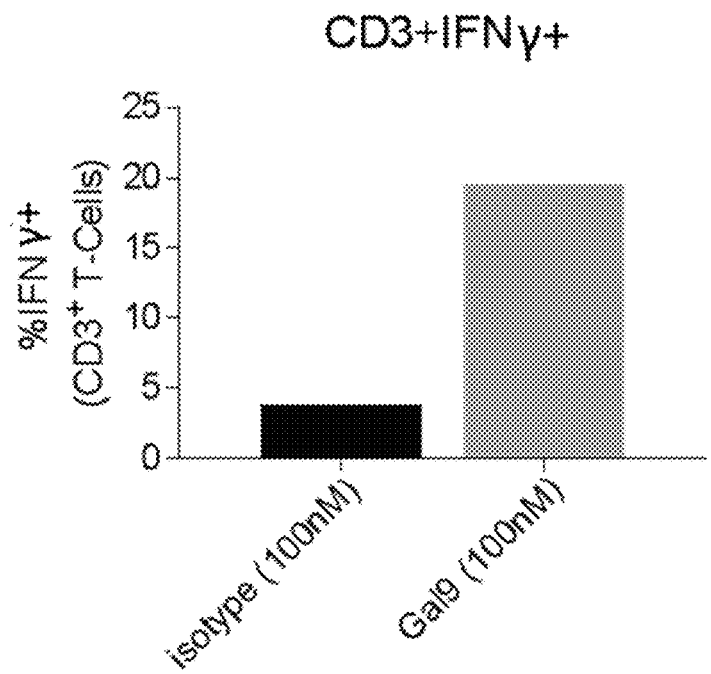
Figure 27A:
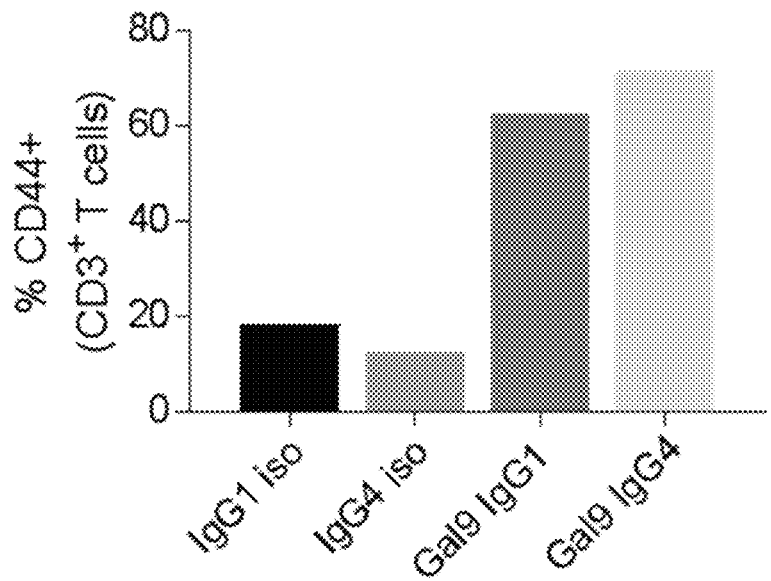
FIGS. 27A-27C depict bar graphs showing CD44 (FIG. 27A), TNF-alpha (FIG. 27B) and IFNgamma (FIG. 27C) expression in CD3+ T cells in pancreatic adenocarcinoma primary tumor sample patient-derived organotypic tumor spheroids (PDOTS) treated with 9.2-17 IgG1 (100 nM) or 9.2-17 IgG4 (100 nM) as compared to IgG1 or IgG4 isotype control (100 nM).
Figure 27B:
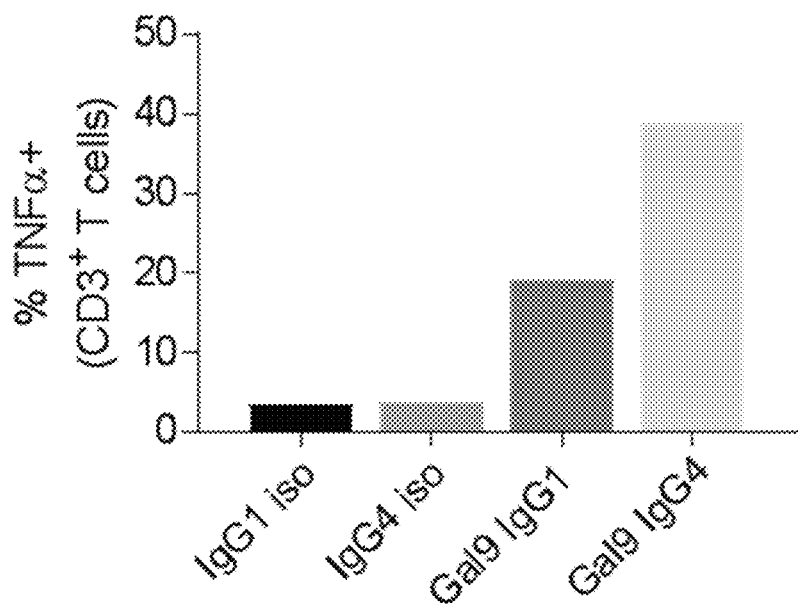
Figure 27C:
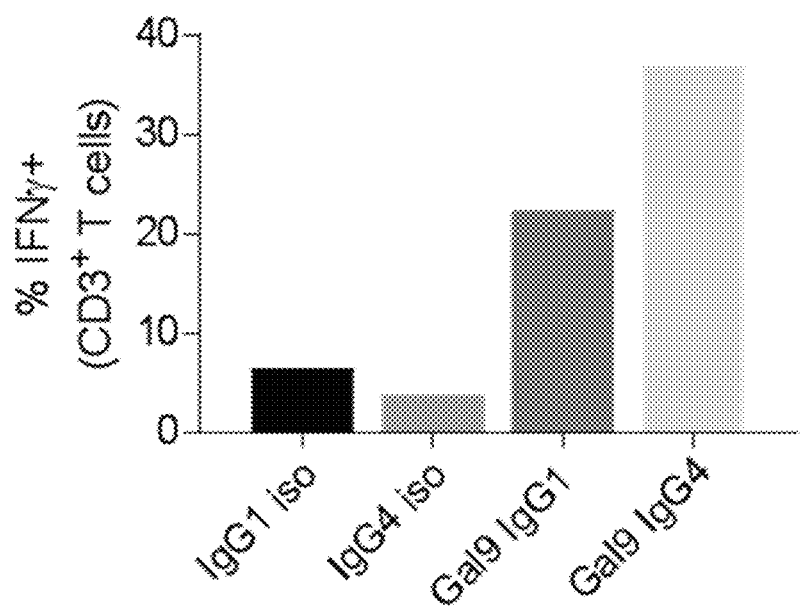
Figure 28A:
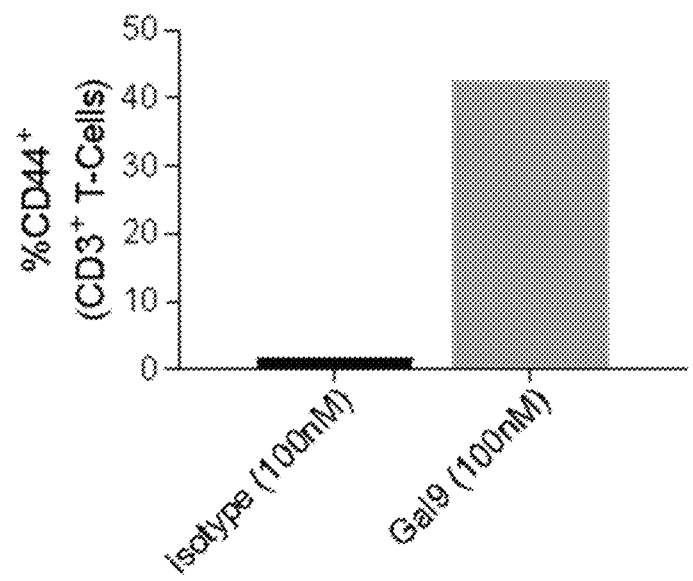
FIGS. 28A-28F depict bar graphs showing immune profile expression in a Gall Bladder Cancer tumor sample (PDOTS) treated with 9.2-17 IgG4 (100 nM) as compared to IgG4 isotype control (100 nM); CD44 in CD3+ T cells (FIG. 28A), TNF-alpha in CD3+ T cells (FIG. 28B), CD44 in CD4+ T cells (FIG. 28C), TNF-alpha in CD4+ T cells (FIG. 28D), CD44 in CD8+ T cells (FIG. 28E), TNF-alpha in CD8+ T cells (FIG. 28F).
Figure 28B:
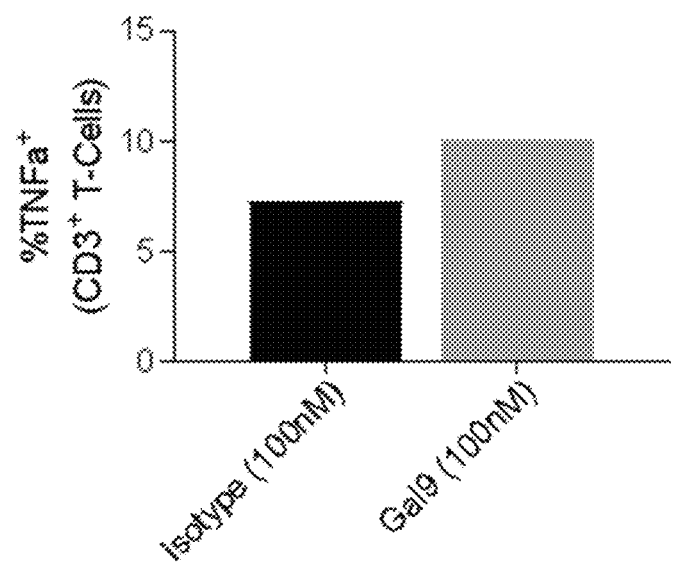
Figure 28C:
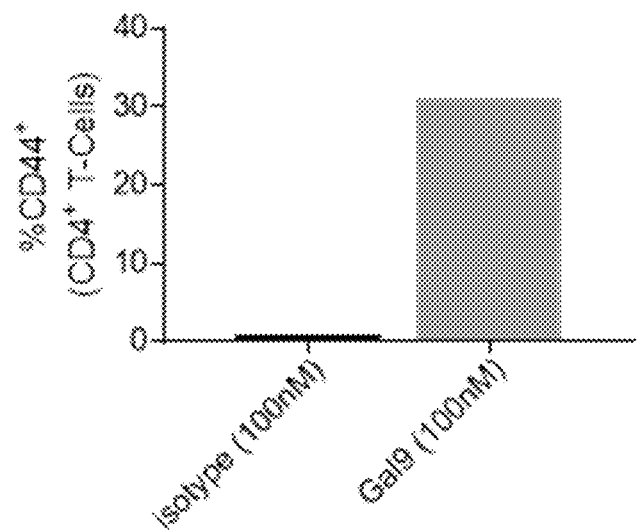
Figure 28D:
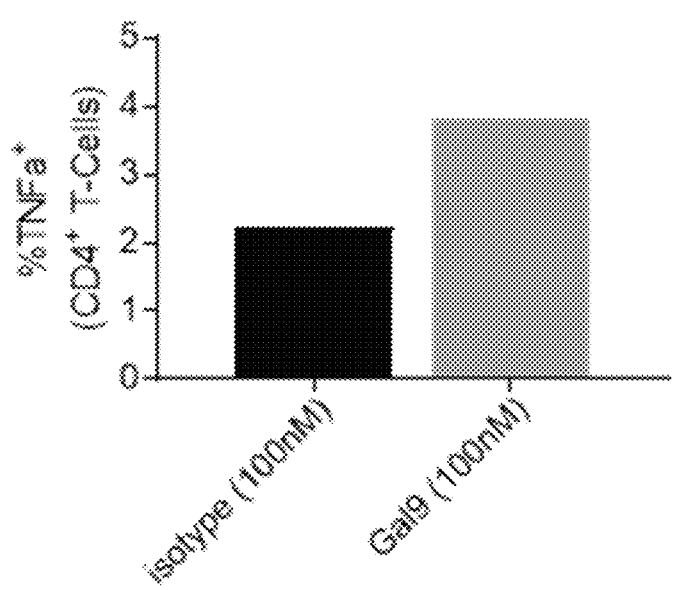
Figure 28E:
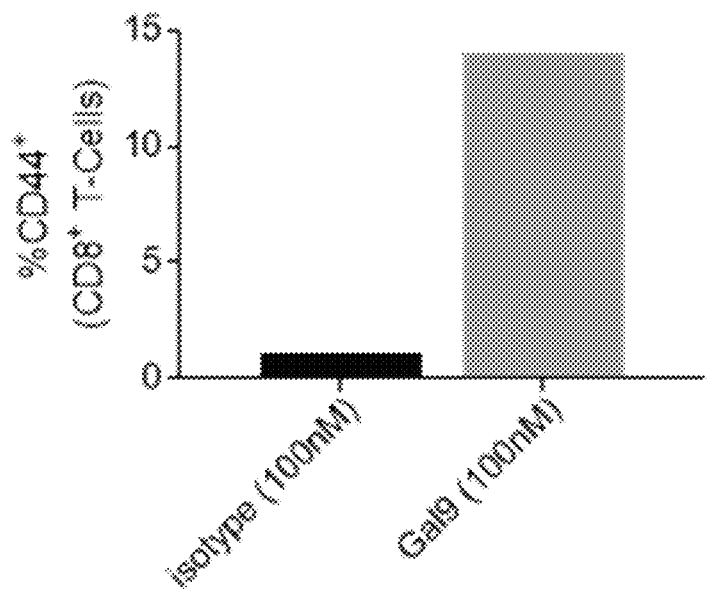
Figure 28F:
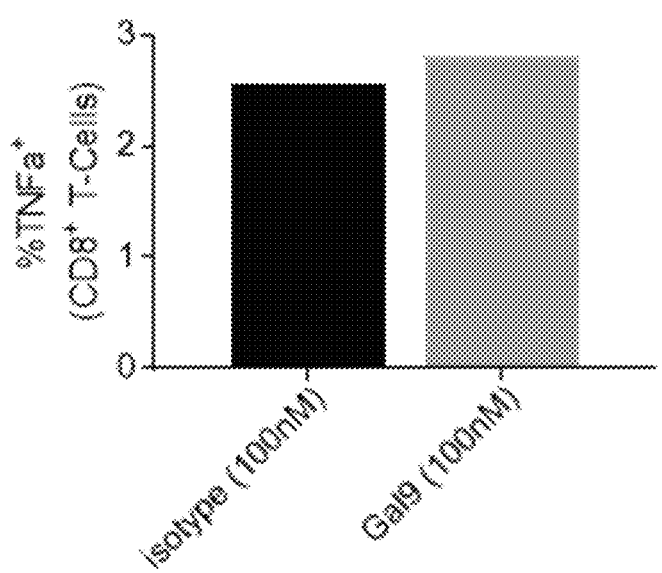
Figure 29A:
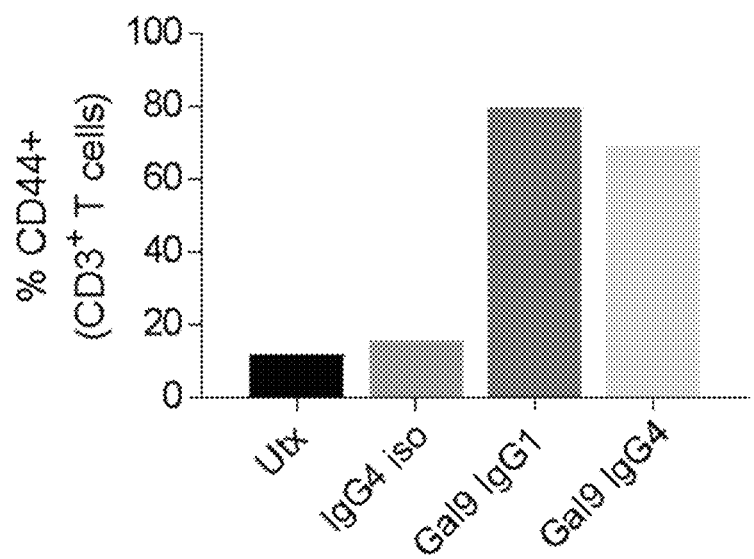
FIGS. 29A-29C depict bar graphs showing CD44 (FIG. 29A), TNF-alpha (FIG. 29B) and IFNgamma (FIG. 29C) expression in CD3+ T cells in a sample of liver metastasis from a colorectal cancer patient (PDOTs) treated with 9.2-17 IgG1 (100 nM) or 9.2-17 IgG4 (100 nM) as compared to IgG1 (100 nM) or untreated control (Utx).
Figure 29B:
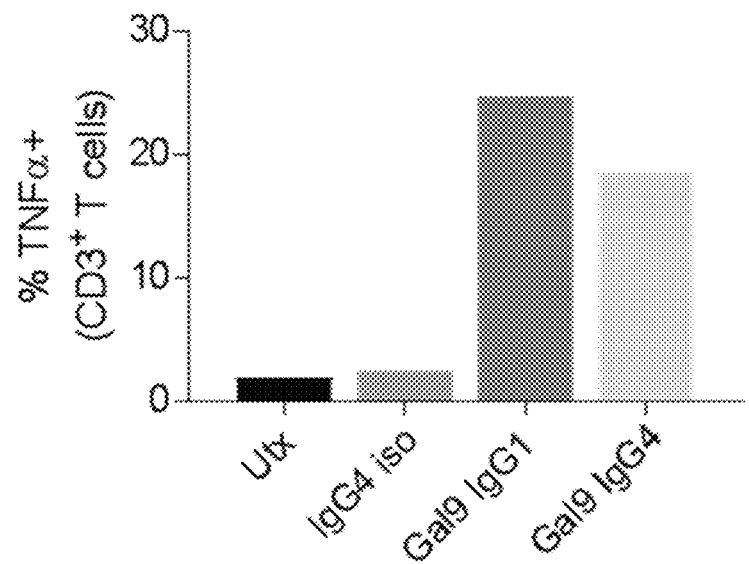
Figure 29C:
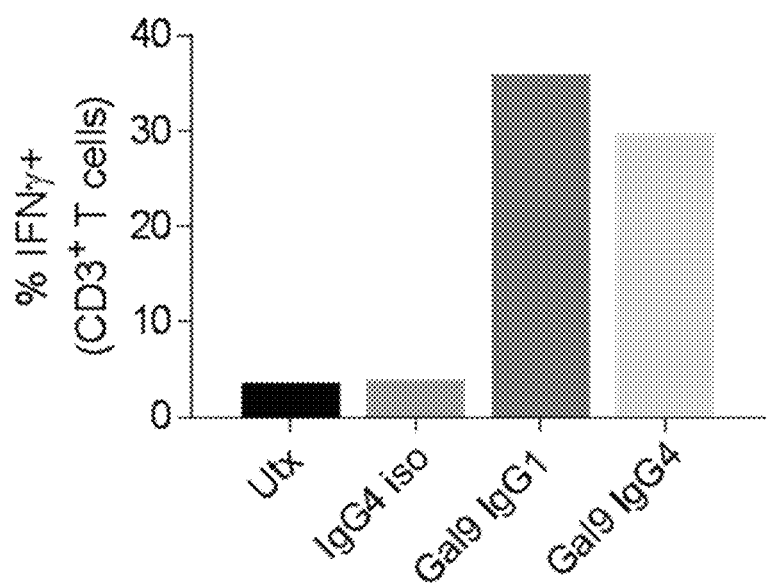

These results show that certain residues within CDR-H2 and CDR-H3 of the G9.1-8 clone can be replaced or truncated with minimal effects on antigen binding. Conversion of G9.1-8 mutant clones from the Fab into the IgG2A format can reduce the dissociation rate, as expected from the bivalent nature of IgG (see, e.g., FIG. 21 and FIG. 22, for example, G9.1-8m13 and G9.1-8m14). Of note, with the original G9.1-8 clone and G9.1-8m8 reactivity with CRD2 was observed (FIG. 25 and data not shown). G9.1-8m12, G9.1-8m13, and G9.1-8m14 do not bind to CRD2 in a bead based assay.

Example 6: Cellular Preparation and Flow Cytometry for Analysis of Mouse and Human Tissues Fresh PDA tumors were placed in cold FACS buffer (PBS with 2% FBS) with Collagenase IV (1 mg/mL; Worthington Biochemical, Lakewood, N.J.), Trypsin inhibitor (1 mg/mL; EMD Millipore, Billerica, Mass.) and DNase I (2 U/mL; Promega, Madison, Wis.), and minced with scissors to sub-millimeter pieces. Tissues were then incubated at 37° C. for 20 min with gentle shaking every 5 min. Specimens were passed through a 70 μm mesh and centrifuged at 350 g for 5 min. Cell pellets were re-suspended in the FACS buffer and 1×106 cells were first stained with zombie yellow (BioLegend) to exclude dead cells. After viability staining, cells were incubated with an anti-CD16/CD32 mAb (eBiosciences, San Diego, Calif.) for blocking FcγRII/II followed by antibody staining with 1 μg of fluorescently conjugated extracellular mAbs. Intracellular staining for cytokines and transcription factors was performed using the Fixation/Permeabilization Solution Kit (eBiosciences). For mouse specimens, we used mouse CD44 (IM7), PD-1 (29F.1A12), CD3 (17A2), CD4 (RM4-5), CD8 (53-6.7), CD45 (30-F11), CD11b (M1/70), Gr1 (RB6-8C5), MHC II (M5/114.15.2), IL-10 (JESS-16E3), IFNγ (XMG1.2), TNFα (MP6-XT22), ICOS (15F9), CD69 (H1.2F3), IL-17A (TC11-18H10.1), TGFα (TW7-16B4), LFA-1 (H155-78), T-bet (eBio4B10), RORγt (AFKJS-9), and FoxP3 (FJK-16s; all eBiosciences). The antibodies were from BioLegend unless otherwise noted. Human flow cytometry antibodies included CD45 (HI30), CD3 (UCHT1), CD4 (A161A1), CD8 (HIT8a), CD44 (BJ18), TNFα (MAb11), IFNγ (4S.B3; all Biolegend). Flow cytometry was carried out on the LSR-II flow cytometer (BD Biosciences). Data were analyzed using FlowJo v.10.1 (Treestar, Ashland, Oreg.).

Example 7: Evaluation of Gal-9 Antibodies Alone or in Combination with Checkpoint Inhibition in a Mouse Model of Pancreatic Cancer and Tumor Mass and Immune Profile of Mice Treated with G9.2-17 mIgG1

The effect of G9.2-17 mIgG1 on tumor weight and on immune profile was assessed in a mouse model of pancreatic cancer. 8-week old C57BL/6 male (Jackson Laboratory, Bar Harbor, Me.) mice were administered intra-pancreatic injections of FC1242 PDA cells derived from Pdx1Cre; KrasG12D; Trp53R172H (KPC) mice (Zambirinis C P, et al., TLR9 ligation in pancreatic stellate cells promotes tumorigenesis. J Exp Med. 2015; 212:2077-94). Tumor cells were suspended in PBS with 50% Matrigel (BD Biosciences, Franklin Lakes, N.J.) and $1 \times 10^5$ tumor cells were injected into the body of the pancreas via laparotomy. Mice (n=10/group) received one pre-treatment dose i.p. followed by 3 doses (q.w.) of commercial αGalectin 9 mAb (RG9-1, 200 ug, BioXcell, Lebanon, N.H.) or G9.2-17 mIgG1 (200 μg), or paired isotype, either G9.2-Iso or rat IgG2a (LTF-2, BioXcell, Lebanon, N.H.) (200 μg) (one dose per week for three weeks). Mice were sacrificed 3 weeks later and tumors were harvested for analyses by flow cytometry. Tissue was processed and prepared and flow cytometric analysis was performed as described in Example 5.

Figure 17:
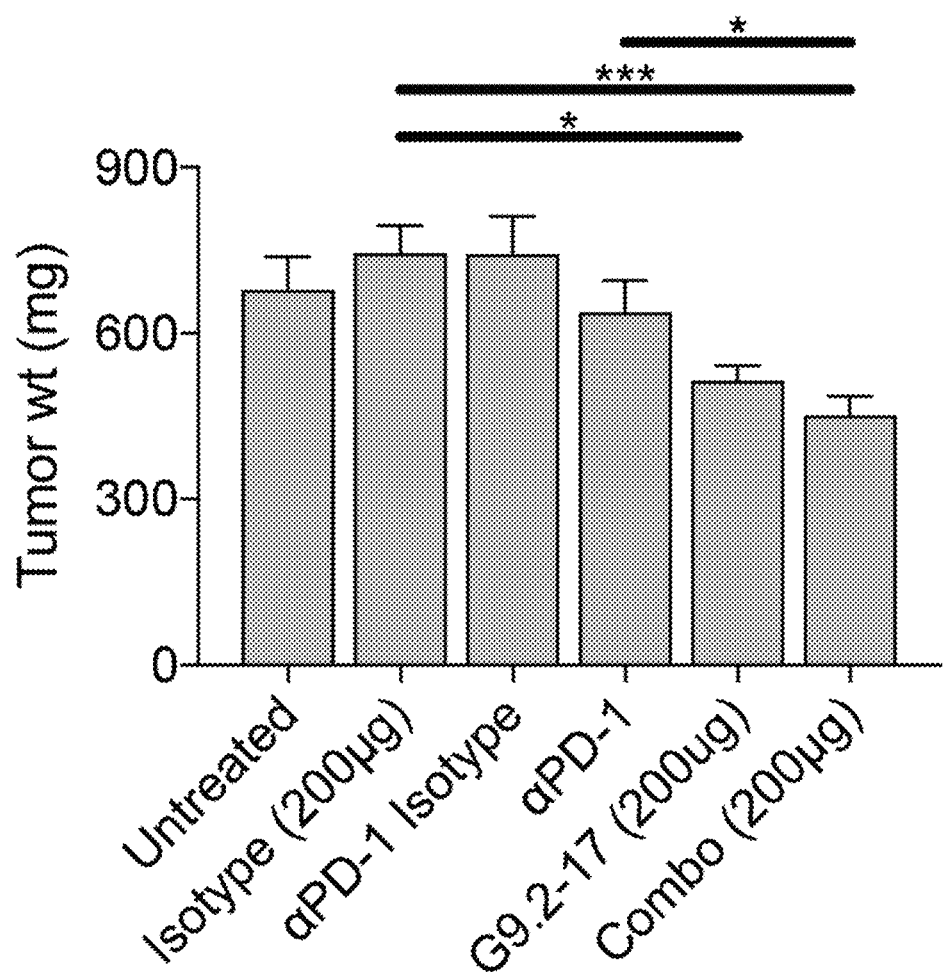
FIG. 17 depicts a bar graph showing tumor weight of mice treated with G9.2-17 mIgG2a alone or in combination with αPD1 mAb. Mice (n=10/group) with orthotopically implanted KPC tumors were treated with commercial αPD-1 (200 µg) mAb or G9.2-17 mIg2a (200 µg), or a combination of G9.2-17 and αPD-1, or matched isotype once weekly for three weeks. Tumors were removed and weighed and subsequently processed and stained for flow cytometry. Each point represents one mouse; *p<0.05; p<0.01; *p<0.001; ****p<0.0001; by unpaired Student's t-test.
Figure 18A:
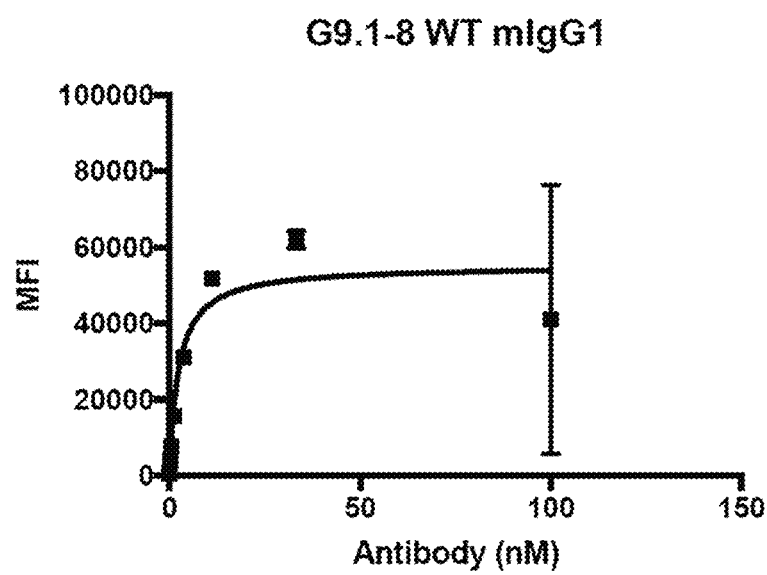
FIGS. 18A-18C depict graphs showing binding of purified G9.1-8m1-5 mIgG1 to human Galectin-9 CRD1 as characterized using a bead-based binding assay.
Figure 18B:
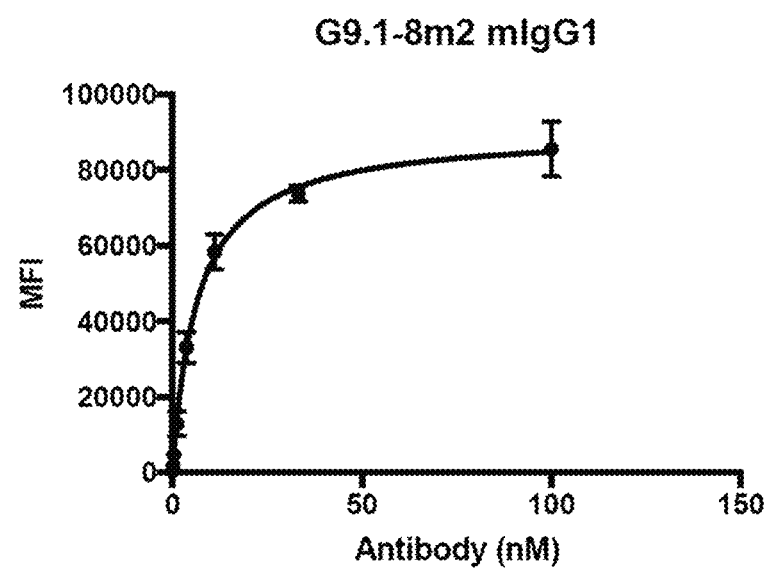
Figure 18C:
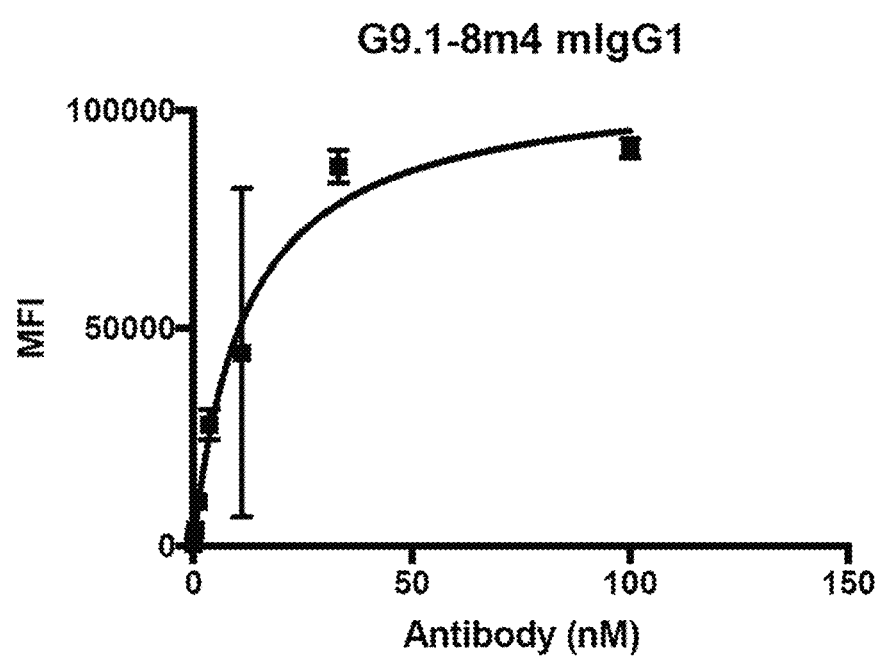
Figure 19A:
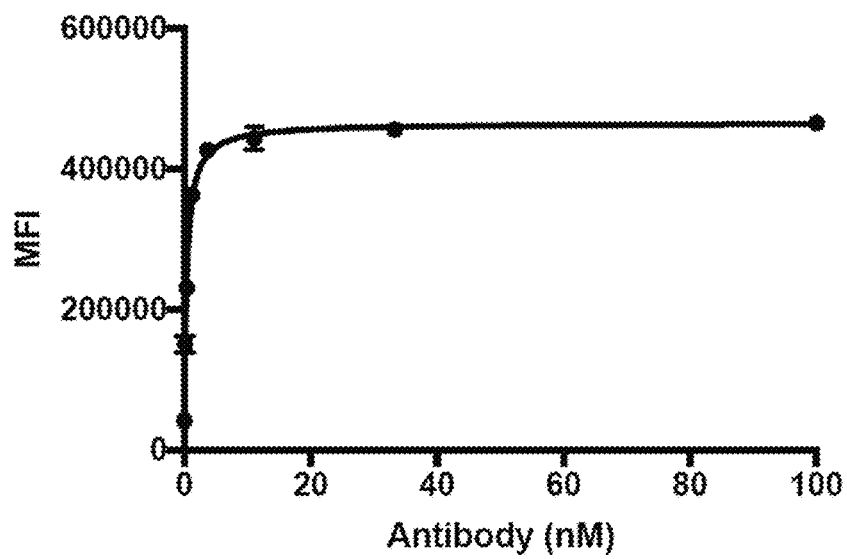
FIGS. 19A-19G depict graphs showing binding of purified G9.1-8m6-11 Fabs to human Galectin-9 CRD1 as characterized using a bead-based binding assay.
Figure 19B:
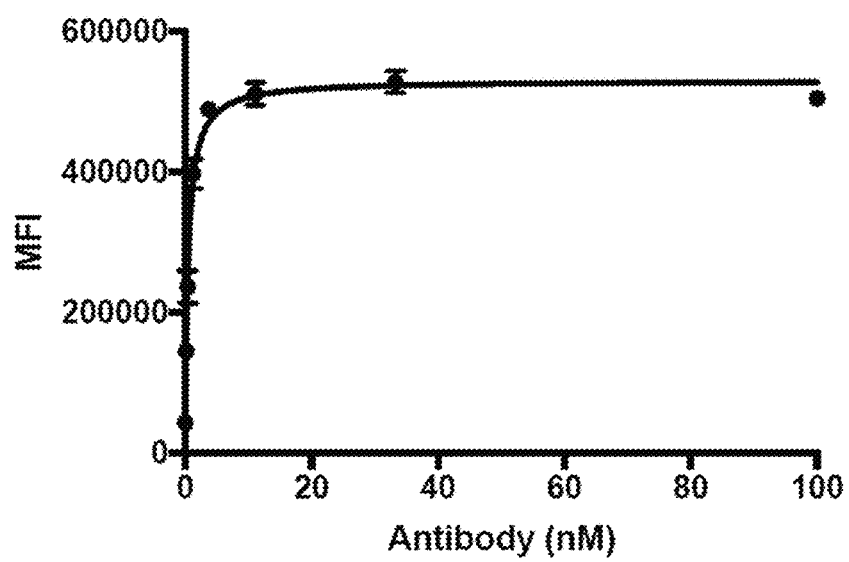
Figure 19C:
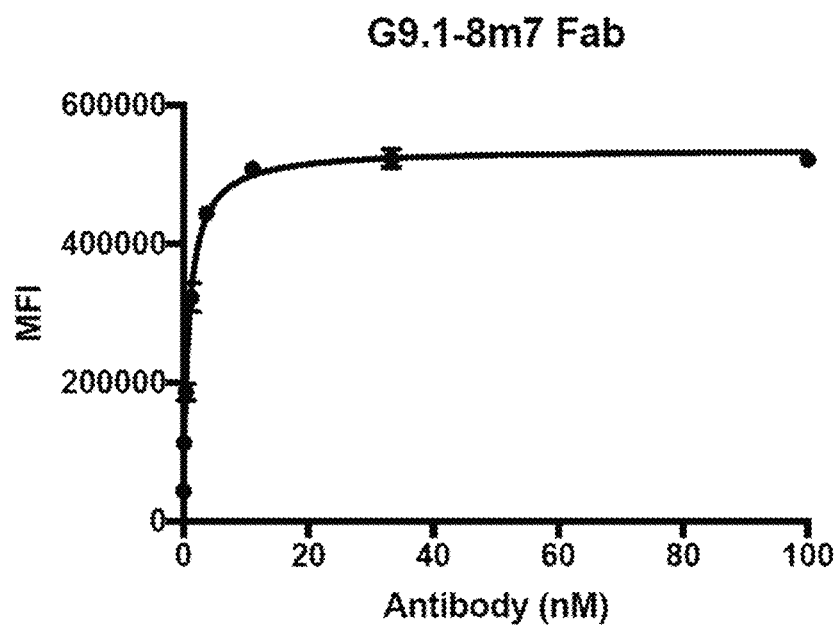
Figure 19D:
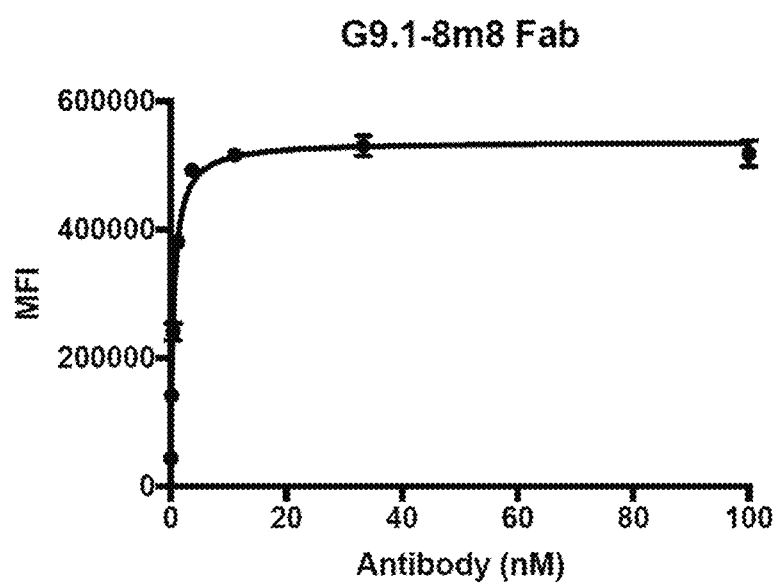
Figure 19E:
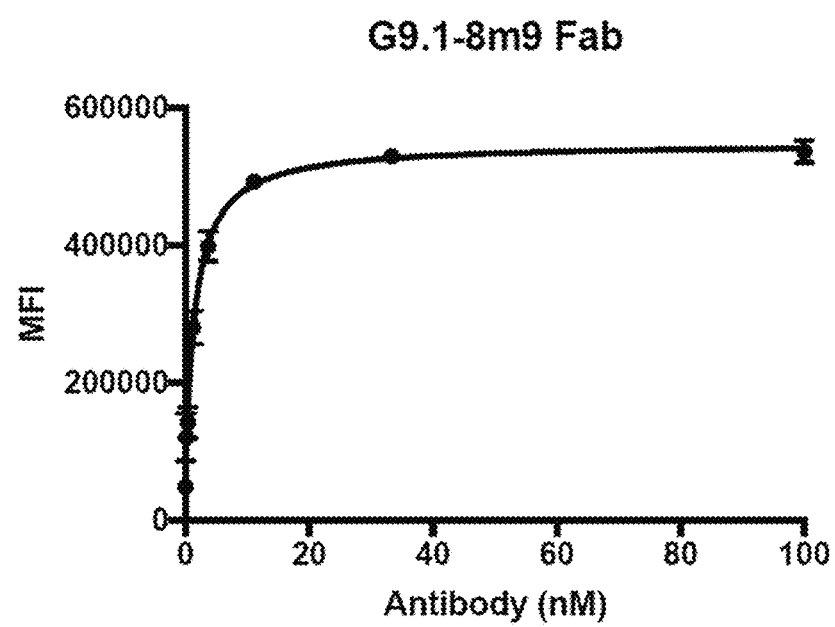
Figure 19F:
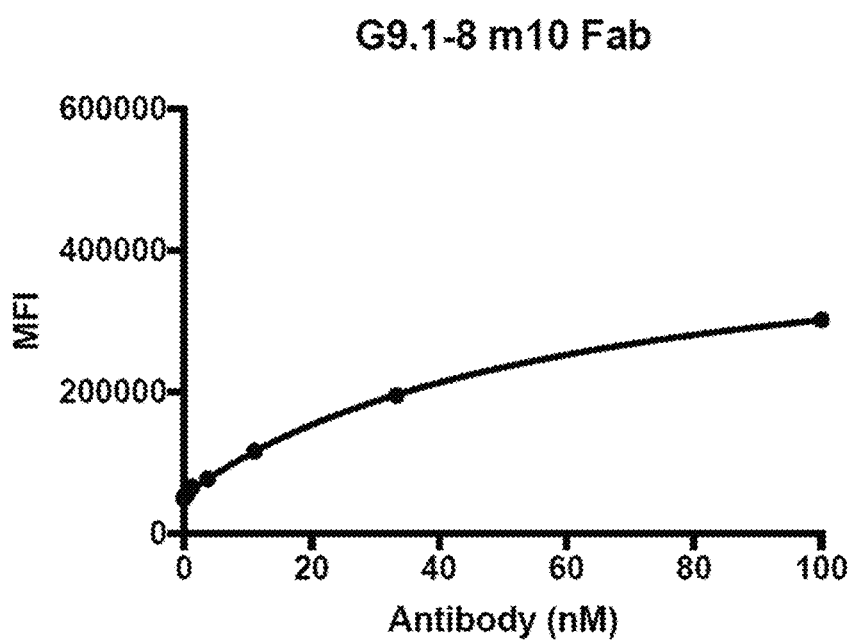
Figure 19G:
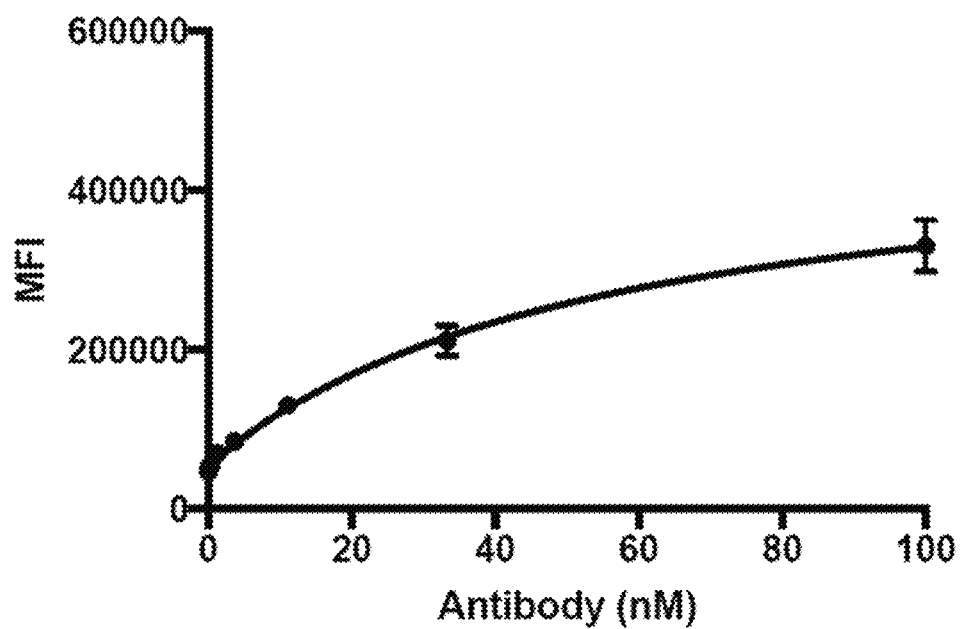
Figure 20A:
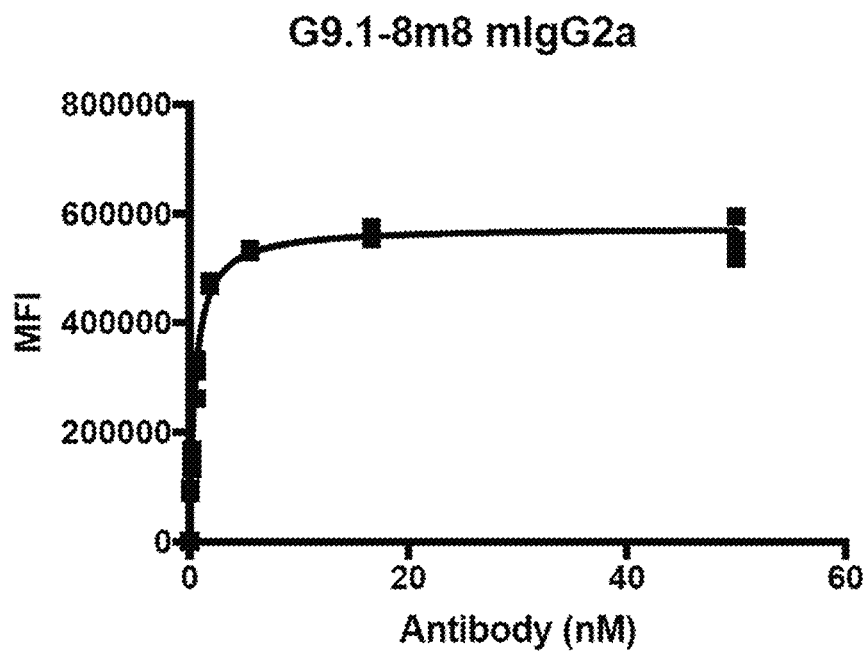
FIGS. 20A-20C depict graphs showing the affinity of purified G9.1-8m8, 9, and 11 mIgG2a antibodies to human Galectin-9 CRD1 as characterized using a bead-based binding assay.
Figure 20B:
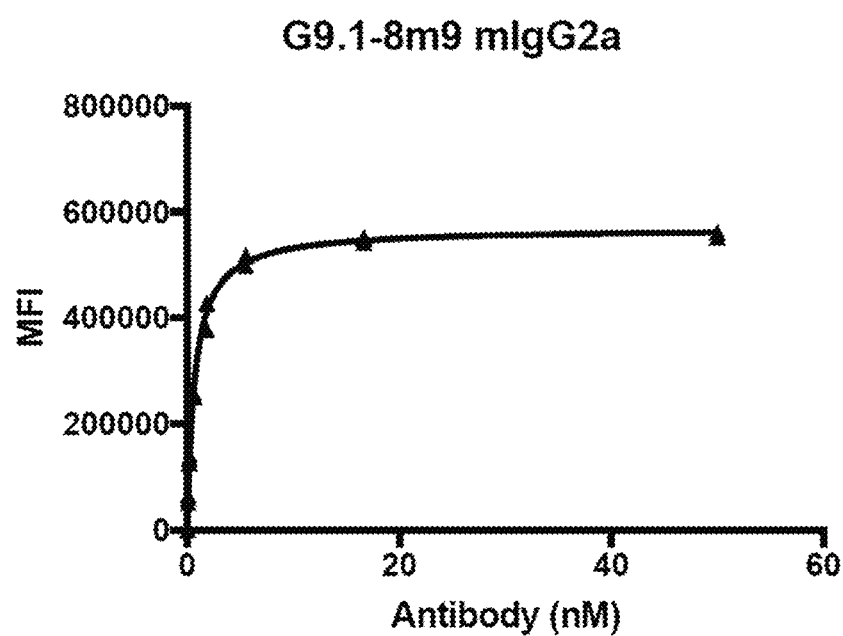
Figure 20C:
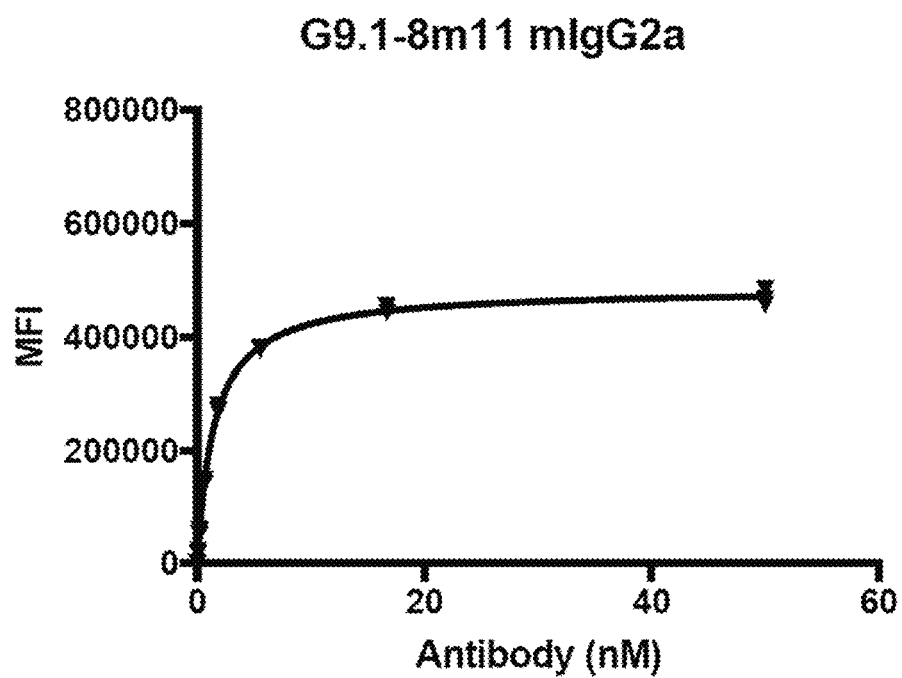
Figure 21A:
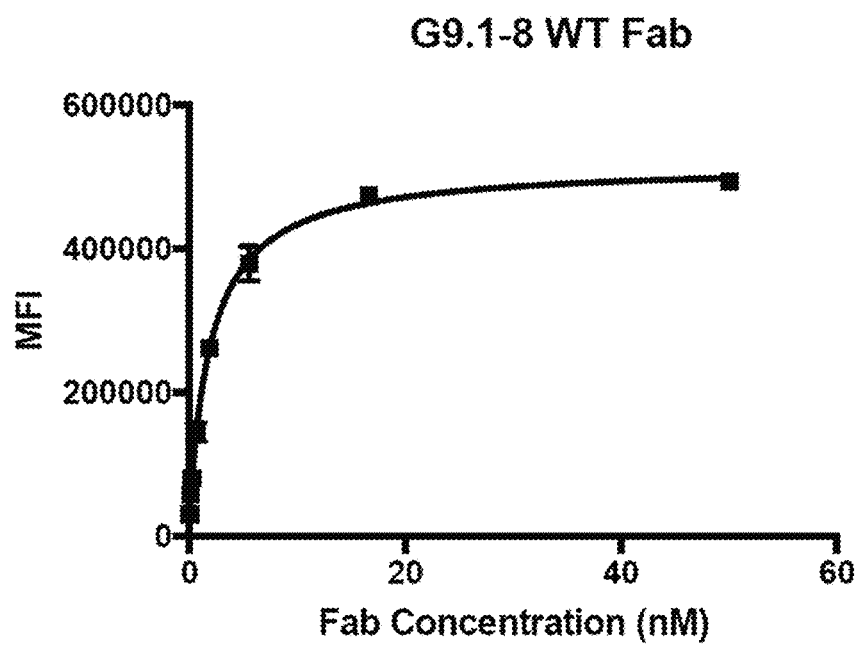
FIGS. 21A-21D depict graphs showing binding of purified G9.1-8m11-14 Fabs to human Galectin-9 CRD1 as characterized using a bead-based binding assay.
Figure 21B:
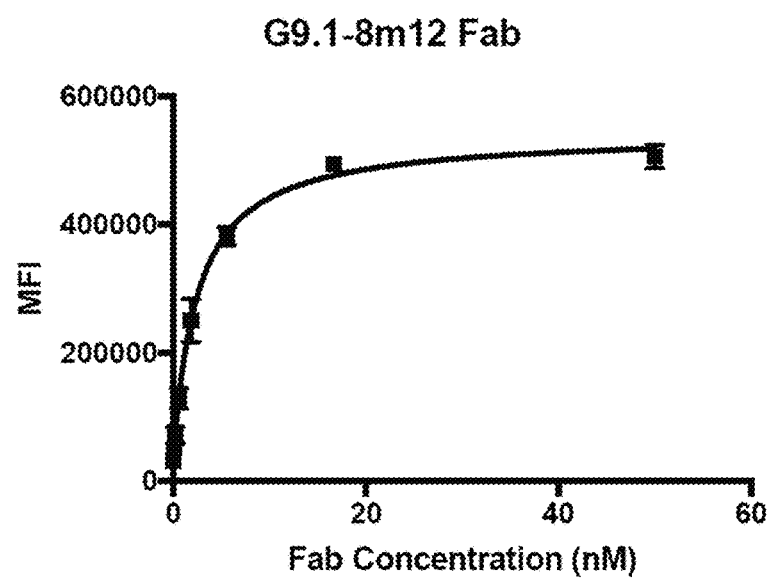
Figure 21C:
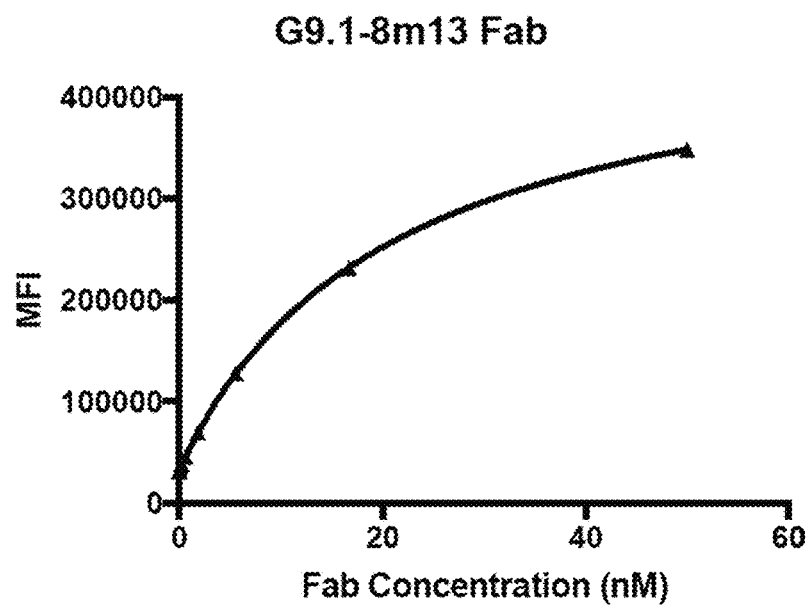
Figure 21D:
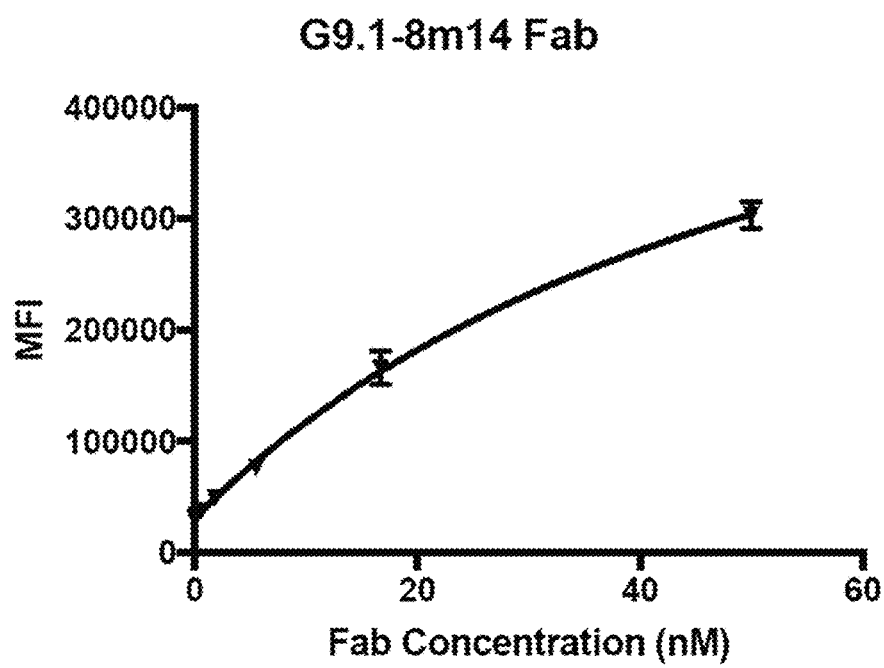
Figure 22A:
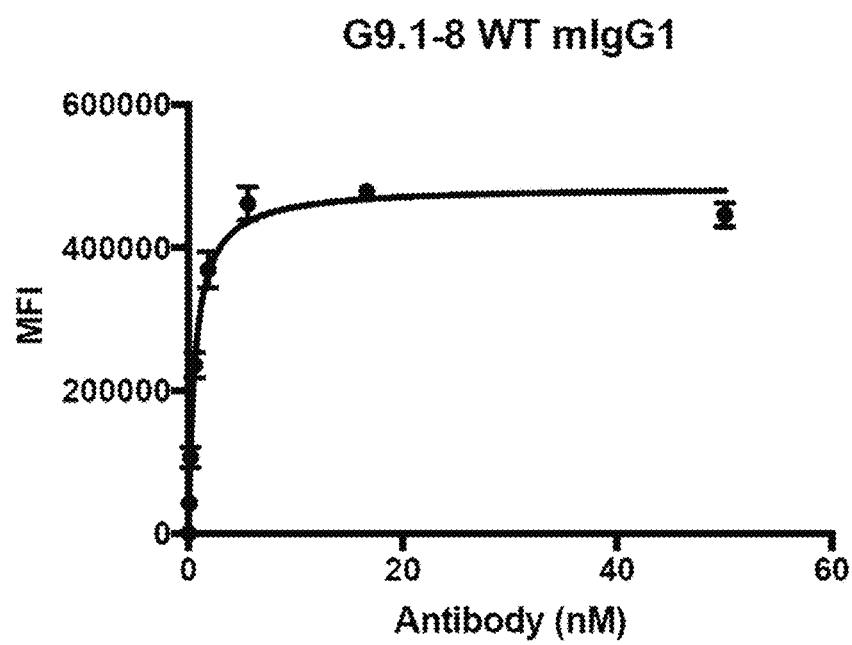
FIGS. 22A-22D depict graphs showing binding of purified G9.1-8m12-14 mIgG2a antibodies to human Galectin-9 CRD1 as characterized using a bead-based binding assay.
Figure 22B:
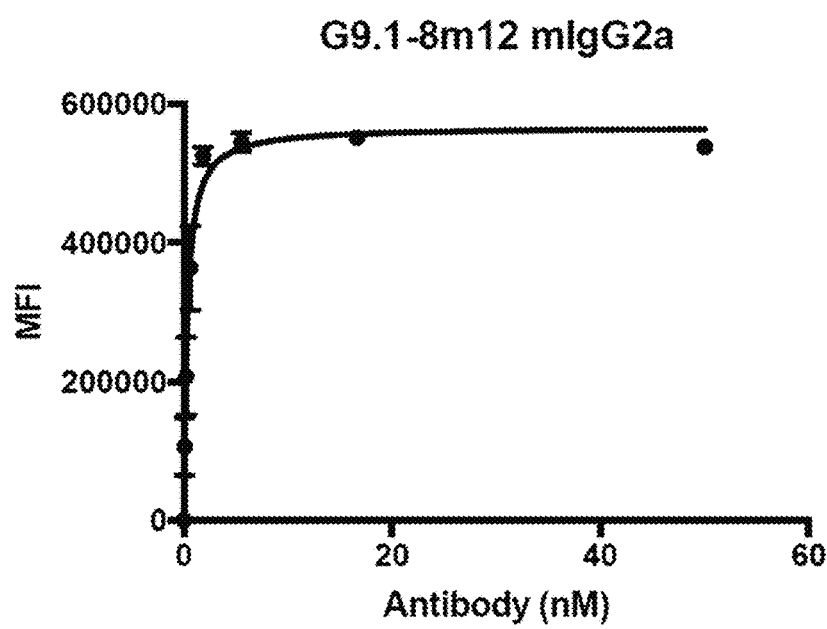
Figure 22C:
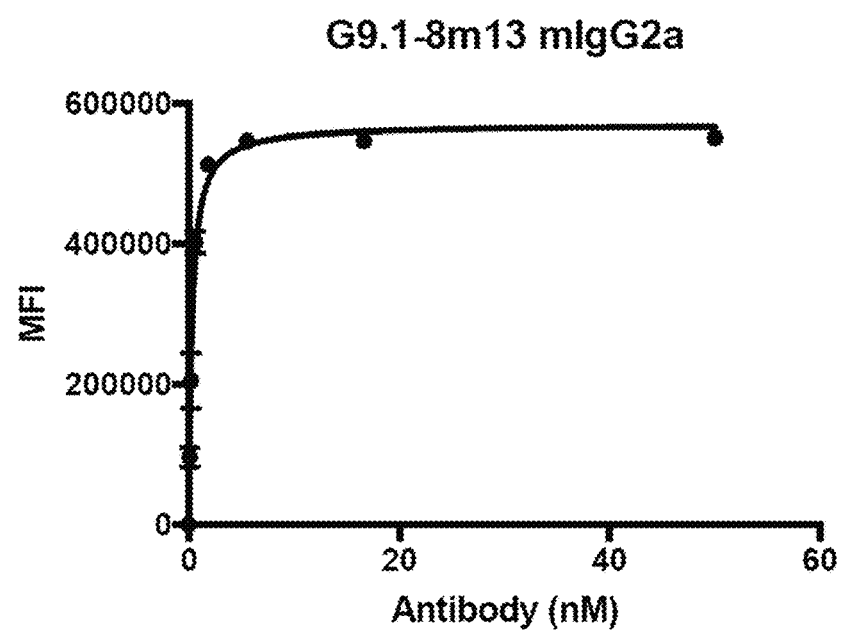
Figure 22D:
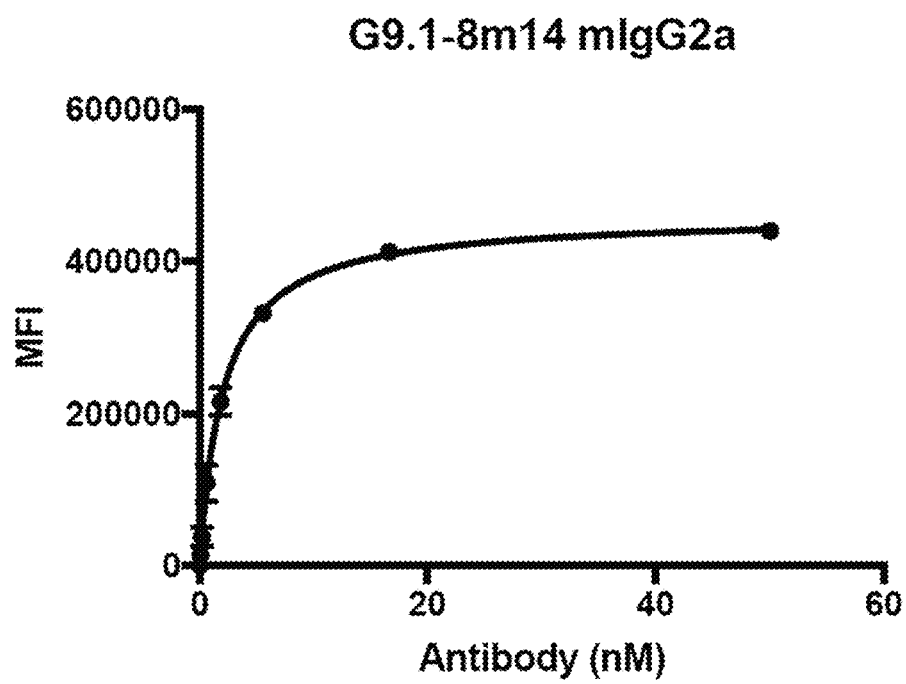

Tumor Mass and Immune Profile of Mice Treated with G9.2-17 mIgG2a Alone or in Combination with αPD1 mAb The effect of G9.2-17 mIgG2a on tumor weight and on immune profile was assessed in a mouse model of pancreatic cancer, alone or in combination with immunotherapy. 8-week old C57BL/6 male mice (Jackson Laboratory, Bar Harbor, Me.) were administered intra-pancreatic injections of FC1242 PDA cells derived from Pdx1Cre; KrasG12D; Trp53R172H (KPC) mice. Tumor cells were suspended in PBS with 50% Matrigel (BD Biosciences, Franklin Lakes, N.J.) and 1×105 tumor cells were injected into the body of the pancreas via laparotomy. Mice received one pre-treatment dose i.p. followed by 3 doses (q.w.) of G9.2-17 mIgG2a (200 μg) or a neutralizing αPD-1 mAb (29F.1A12, 200 μg, BioXcell, Lebanon, N.H.), separately or in combination, or paired isotype (LTF-2 and C1.18.4, BioXcell, Lebanon, N.H.) as indicated. Mice were sacrificed on day 26 and tumors were harvested for analyses. Tissue was processed and prepared and flow cytometric analysis was performed as described in Example 5. Results are shown in FIGS. 17A-17C. Each point represents one mouse; *p<0.05; p<0.01; *p<0.001; ****p<0.0001; by unpaired Student's t-test. These results show single-agent treatment with G9.2-17 mIgG2a reduces tumor growth at both of the dose levels, whereas anti-PD-1 alone had no effect on tumor size.

Example 8: Spheroid Preparation and Analysis of Effect of Anti-Gal9 Antibody in Tumor Spheroids Derived from Patient Samples Patient-derived organotypic tumor spheroids (PDOTS) were prepared from fresh patient tumor specimens (pancreatic adenocarcinoma, gall bladder cancer, and liver metastasis from a colorectal cancer). Briefly, specimens were received in media on ice and minced in 10 cm dishes and resuspended in DMEM+10% FBS+100 U/mL collagenase type IV. Partially digested samples were pelleted, re-suspended, and strained over both 100 µm and 40 µm filters to generate S1 (>100 µm), S2 (40-100 µm), and S3 (<40 µm) spheroid fractions, which were subsequently maintained in low-attachment tissue culture plates. An aliquot of the S2 fraction was pelleted and resuspended in type I rat tail collagen at a concentration of 2.5 mg/mL following addition of 10×PBS with phenol red with pH adjusted using NaOH. The spheroid-collagen mixture was injected into the center gel region of the DAX-1 3D microfluidic cell culture chip. After 30 minutes at 37° C., collagen hydrogels containing PDOTS were hydrated with media and treated with Gal9 antibody (G9.2-17). Three days later, PDOTS were harvested and were flowed for immune changes. Preliminary results on single patient samples are shown in FIGS. 26-29. If more than 100 cells were obtained, then cells were sorted for CD3+, CD4+ and CD8+, otherwise cells were only sorted for CD3+.

Example 9: Characterization of Effector Function, Cross-Reactivity and Immunogenicity of Gal-9 Antibodies Antibody-Dependent Cell-Mediated Cytotoxicity (ADCC) Assay In antibody-dependent cell-mediated cytotoxicity (ADCC), effector cells lyse target cells on which antibodies have bound to specific antigens on the target cell membrane. The ADCC which is developed is designed to characterize the Fc effector function of antibodies and measure ADCC activity. Although the initial assay developed relied on both target and effector cells, the assay is further improved by directly coating the antigen of interest onto plates, bypassing the need for target cells. A recombinant Jurkat T-cell line expressing firefly luciferase gene under the control of NFAT response elements with constitutive expression of human FcγRIIIa is used as an effector cell line. Antigen coated onto sterile ELISA plates is used as a target and the test antibody is incubated with the antigen to allow biding through the Fab fragment. Effector cells displaying the correct type of FcgR are then incubated with the antigen/antibody complex on the plate. When the Fc portion of the antibody binds to the FcγRIIIa on the surface of effector cells, receptor cross-linking leads to activation of the NFAT pathway, resulting in luciferase expression. Gene expression is allowed to proceed for 5-6 hours and luciferase activity is measured using a luminometer. A dose-response curve is generated for each antibody.

Antibody-Dependent Cell-Mediated Phagocytosis (ADCP) Assay

Antibody-dependent cell-mediated phagocytosis (ADCP) is an important mechanism of action for antibodies that mediate part or all of their action though phagocytosis. In that case, antibodies mediate uptake of specific antigens by antigen presenting cells. ADCP can be mediated by monocytes, macrophages, neutrophils, and dendritic cells, through FcγRIIa, FcγRI, and FcγRIIIa, of which FcγRIIa (CD32a) on macrophages represent the predominant pathway. In the ADCP assay being employed, THP-1 cells (human monocytic cell line derived from an acute monocytic leukemia patient) are used to measure ADCP. Fluorescently labeled beads are conjugated with the target antigen, then incubated with the test antibody. THP-1 cells are then added to the plate to allow their binding to the Fc fraction of antibodies bound to antigen-coated fluorescent beads. Antibody binding to the beads and engagement of the Fc-receptor results in an uptake of the beads by the THP-1 cells through a phagocytic mechanism. Phagocytosis events are analyzed using flow cytometry. Total amount of fluorescence in each cell (representing the number of beads phagocytosed) and the percentage of fluorescence-positive cells (representing the frequency of phagocytosis) are measured. A dose-dependent curve is generated to assess the ADCP activity mediated by each test antibody.

Cross Reactivity Assay

Off-target toxicity can present a significant problem during drug development of a therapeutic monoclonal antibody. As such, specificity is a critical factor to assess as part the characterization of any new monoclonal candidate and an important indicator of its predicted safety. In order to assess antibody specificity and cross-reactivity, test antibodies and test samples are tested for binding against a human proteomic array consisting of an extensive collection of human proteins—both native and denatured—and at two working concentrations. Antibody specificity is evaluated using CDI's HuProt Human Proteome Microarray (~75% of the human proteome). The microarray is incubated with the primary antibody, rinsed, incubated with a fluorescently-labelled secondary antibody and subsequently analyzed for the amount of fluorescence detected for each target protein. Results are compiled as microarray images.

Detection of Anti-Drug Antibodies (ADA)

Detection of anti-drug antibodies is performed on mouse sera from animals treated with the anti-Gal9 mAbs in vivo. The ADA assay is run on the Mesoscale Discovery (MSD) platform due to its increased sensitivity and dynamic range over standard ELISA methods. Biotin-conjugated Gal9 and sulfo-tagged anti-Gal9 antibodies (drug) will be incubated with test sera to form a bridge complex. ADA bridging complexes will be bound to streptavidin plates and the presence of ADA in the test serum samples will be detected by electrochemiluminescence detection.

Example 10: Evaluation of CRD2 Clone 17 IgG1 and IgG4 Human Galectin 9 Monoclonal Antibodies in a Model of Acute Myeloid Leukemia (AML) in Humanized Mice A study is conducted to evaluate CRD2 clone 17 IgG1 and IgG4 human Galectin 9 monoclonal antibodies in a model of Acute Myeloid Leukemia in humanized mice (CTG-2243, Champions). The study protocol is depicted in Table 10.

TABLE 10

| AML Efficacy Study Design: | | | | |
|---|---|---|---|---|
| Group | -n- | Agent | Dose (ug/dose) | ROA/Schedule |
| 1 | 10 | Vehicle Control | — | p.o./qwx4 |
| 2 | 10 | Control IgG1/4 | 100 | p.o./qwx4 |
| 3 | 10 | Control IgG1/4 | 200 | p.o./qwx4 |
| 4 | 10 | Control IgG 1/4 | 400 | p.o./qwx4 |
| 5 | 10 | Anti-Gal9 1/4 | 100 | p.o./qwx4 |
| 6 | 10 | Anti-Gal9 1/4 | 200 | p.o./qwx4 |

TABLE 10-continued

AML Efficacy Study Design:

| Group | -n- | Agent | Dose (ug/dose) | ROA/Schedule |
|---|---|---|---|---|
| 7 | 10 | Anti- Gal9 1/4 | 400 | p.o./qwx4 |
| 8 | 10 | Cytarabine | 50 | QDx5 |
| 9 | 10 | Cytarabine vehicle | — | QDx5 |

Study Animal Preparation

Animals are sublethally irradiated and reconstituted with 1-5 million primary AML cells via tail vein injection. In-life blood collection is performed once monthly and flow cytometry is conducted using the following flow panel: huCD45/muCD45/huCD3/huCD33 for determination of engraftment. Once human CD33+ levels reach 20-1000 counts/ul, 6 surrogate animals are euthanized for comprehensive immunophenotyping and spleen, bone marrow and peripheral blood is analyzed by the flow panel above. Animals are randomized into treatment groups based on peripheral blood counts. Disseminated Tumor growth/burden analysis is conducted up to 42 days dosing and observation. Terminal half whole blood is processed and analyzed for immune parameters and serum is used for Gal9 ELISA.

Terminal blood and bone marrow is collected for flow cytometry. 8-color cell surface flow cytometry is performed from terminal bone marrow and peripheral blood from all animals: The flow panels are: LD/huCD45/huCD3/huCD33/huGalectin9/huTim9/huPD1/huCD34/huCD38/huCD117.

Fresh fecal samples are collected from all animals (1 pellet/mouse) in a polypropylene tube at baseline (prior to treatment initiation), at the end of Week1 of treatment, and at study endpoint. The collected samples will aree snap frozen and stored at −80° C. If possible, a terminal blood sample and tissues described is collected to assess drug toxicity.

Data Analysis

To assess animal toxicity, beginning on Day 0, animals are observed daily and weighed 3× weekly using a digital scale; data including individual and mean gram weights (Mean We±SEM), mean percent weight change versus Day 0 (% $vD_0$) are recorded for each group and % $vD_0$ is plotted at study completion. Any animal deaths are recorded daily and designated as drug-related (D), technical (T), tumor-related (B), or unknown (U) based on weight loss and gross observation; single agent or combination groups reporting a mean % $vD_0$>20% and/or >10% mortality are considered above the maximum tolerated dose (MTD) for that treatment on the evaluated regimen. Maximum mean % $vD_0$ (weight nadir) for each treatment group is reported at study completion. To assess efficacy of the Gal-9 antibody, tumor growth inhibition is measured. Beginning on Day 0, tumor dimensions are measured 3× weekly by digital caliper and data, including individual and mean estimated tumor volumes (Mean TV±SEM), are recorded for each group; tumor volume (TV) is calculated using the formula TV=width$^2$×length×0.52. At study completion, percent tumor growth inhibition (% TGI) values are calculated and reported for each treatment group (T) versus control (C) using initial (i) and final (f) tumor measurements by the formula % TGI=1−$(T_f-T_i)/(C_f-C_i)$. Individual mice reporting a tumor volume ≤30% of the Day 0 measurement for two consecutive measurements are considered partial responders (PR). Individual mice lacking palpable tumors (0.00 mm$^3$ for two consecutive measurements) are classified as complete responders (CR); a CR that persists until study completion is considered a tumor-free survivor (TFS). Tumor doubling time (DT) is determined for the vehicle treated groups using the formula DT=$(D_f-D_i)$*log$^2$/(log $TV_f$-log $TV_i$) where D=Day and TV=Tumor Volume. All data collected in this study is managed electronically and stored on a redundant server system.

Example 11: Evaluation of Gal-9 Antibody in a B16F10 Melanoma Syngeneic Tumor Model in Immunocompetent Mice Gal-9 antibody G9.2-17 was evaluated in the B16F10 syngeneic mouse model of melanoma immunocompetent mice. Pre-study animals (female C57BL/6, 6-8 weeks of age (Charles River Labs)) were unilaterally implanted subcutaneously on the left flank with 5e5 B16.F10 in 100 µl PBS. Pre-study tumor volumes were recorded for each experiment beginning 2-3 days after implantation. When tumors reached an average tumor volume of 50-100 mm$^3$ (preferably 50-75 mm$^3$) animals were matched by tumor volume into treatment or control groups (n=8) to be used for dosing and dosing was initiated on Day 0. Animals were dosed on day 0 and day 4 i.v. The study design for testing of Anti-Gal9 G9.2-17 IgG1 and Anti-Gal9 G9.2-17 IgG2 is summarized in Table 11 and Table 12.

TABLE 11

Anti-Gal9 IgG1

| Group | -n- | Test Agent | Dose (ug/mouse) | Dose Volume | Route of Administration (ROA) |
|---|---|---|---|---|---|
| 1 | 8 | Control Untreated | — | — | — |
| 2 | 8 | Control mIgG1 | 200 ug | 200 ul | IV |
| 7 | 8 | Anti-Gal9 mIgG1 (G9.2-17) | 200 ug | 200 ul | IV |

TABLE 12

Anti-Gal9 IgG2

| Group | -n- | Test Agent | Dose (ug/mouse) | Dose Volume | Route of Administration (ROA) | Schedule | Total Number of Doses |
|---|---|---|---|---|---|---|---|
| 1 | 10 | Control Untreated | — | — | — | — | — |
| 2 | 10 | Control mIgG2 | 200 ug | 200 ul | IV | Q4Dx6 | 6 |
| 3 | 10 | Control mIgG2 | 200 ug | 200 ul | IP | BIWx4 | 8 |
| 4 | 10 | Anti-Gal9 mIgG2 (G9.2-17) | 200 ug | 200 ul | IV | Q4Dx6 | 6 |

Figure 30:
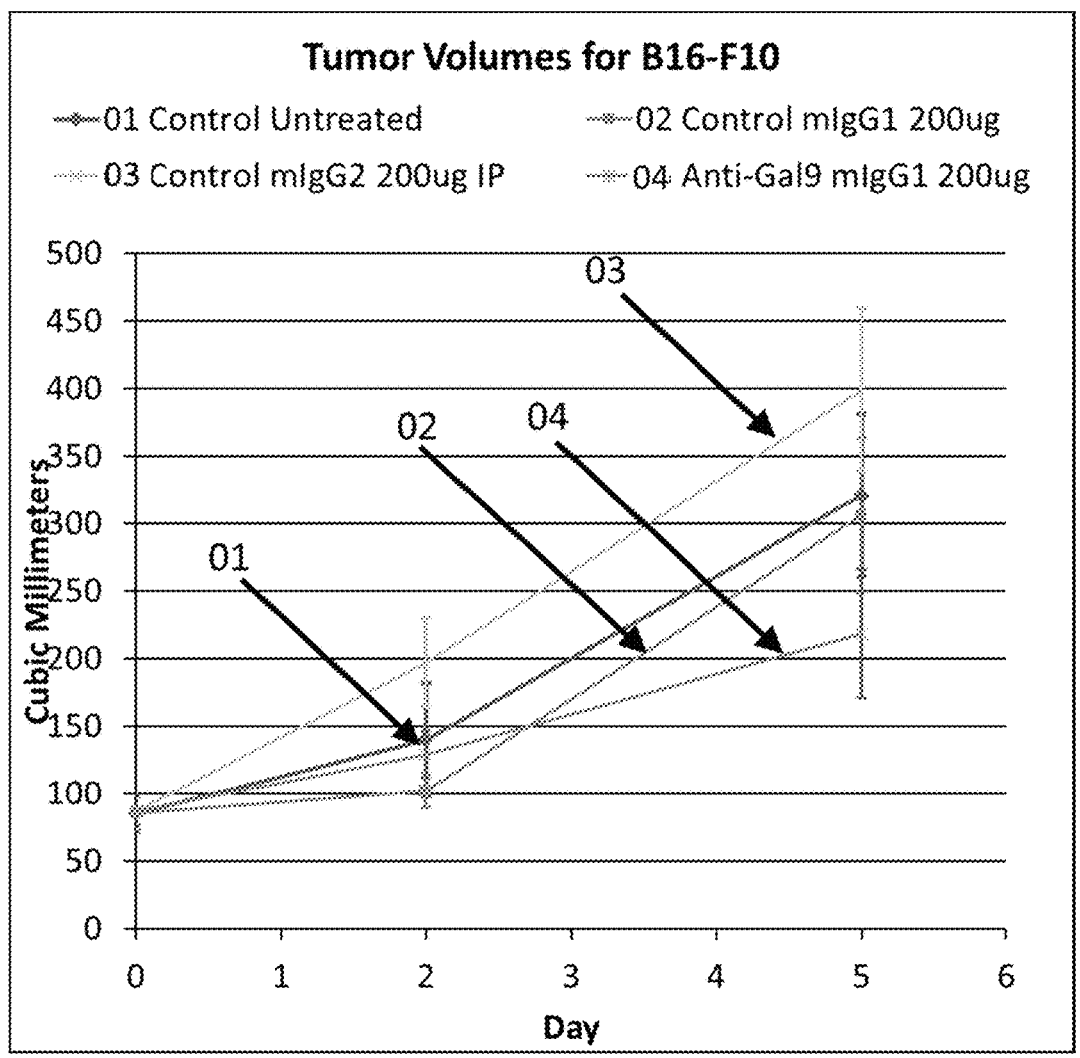
FIG. 30 depicts a line graph showing the effect of 9.2-17 in a B16F10 subcutaneous syngeneic model. Tumors were engrafted subcutaneously and treated with G9.2-17 IgG1 mouse mAb. Animals were dosed on day 0 and day 4 intravenously (i.v.) unless otherwise specified in the legend.
Figure 31:
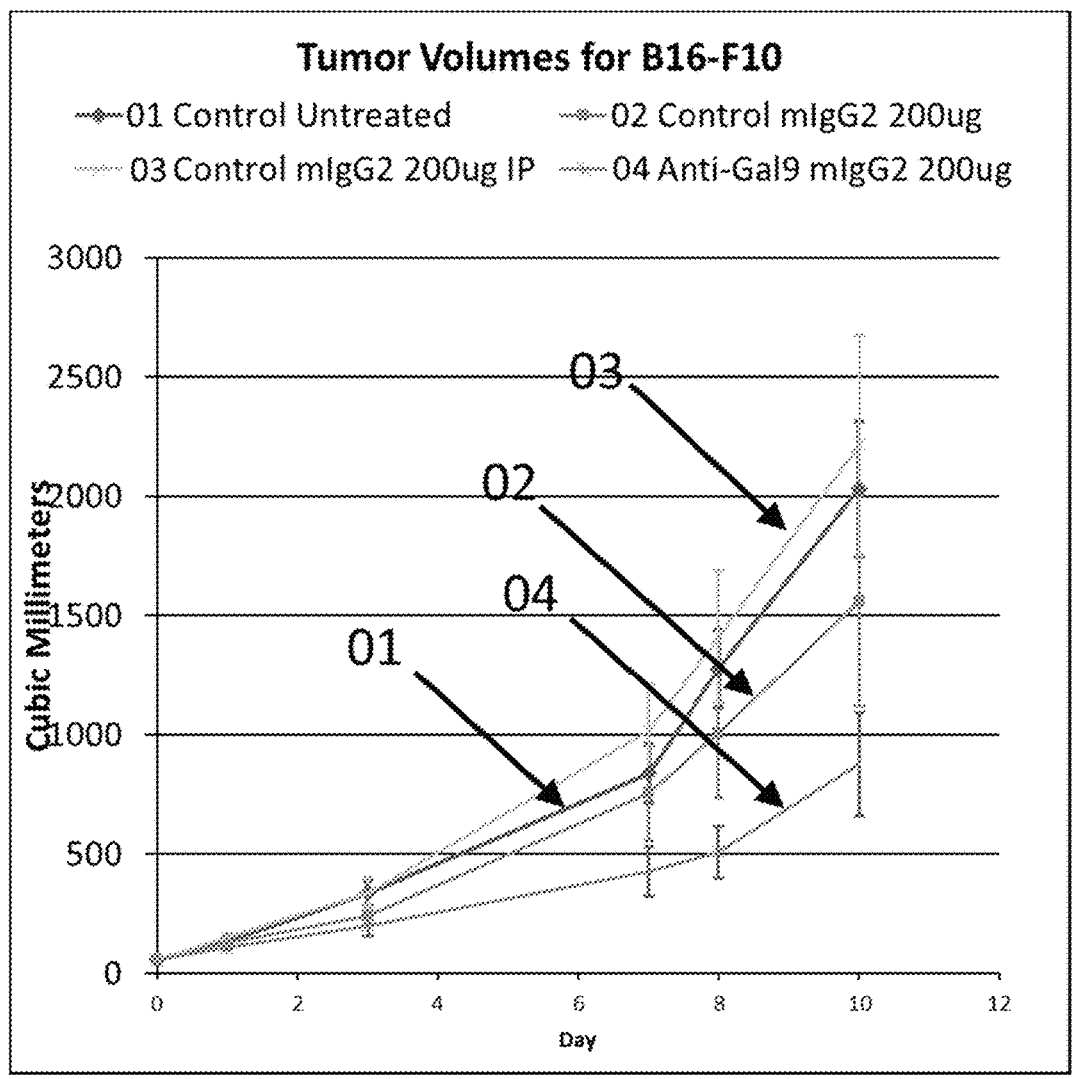
FIG. 31 depicts a line graph showing the effect of 9.2-17 in a B16F10 subcutaneous syngeneic model. Tumors were engrafted subcutaneously and treated with G9.2-17 IgG2a mouse mAb. Animals were dosed on day 0 and once every 4 days thereafter until the end of the experiment. mAbs were administered i.v. unless otherwise specified in the legend.
Figure 32:
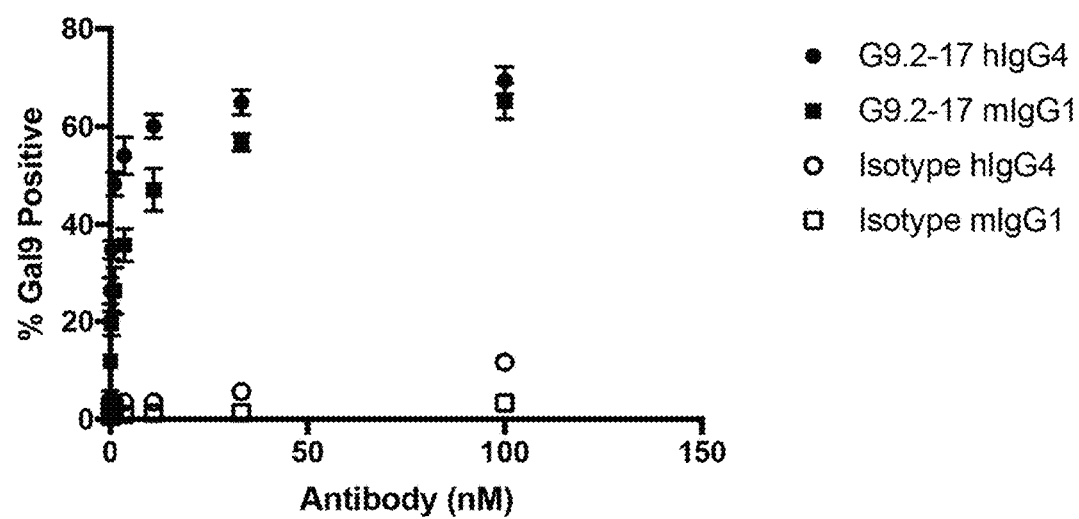
FIG. 32 depicts a graph showing a cell based binding assay CRL-2134 cell lines were incubated with a biotinylated Fab, and bound Fab was detected using neutravidin conjugated with DyLight 650. Samples were then analyzed using flow cytometry. Strong signals were observed for the Galectin-9 antibody 9.2-17, but not for the isotype controls. The $K_D$ (nM) values for the Gal-9 antibodies in the two formats were as follows: G9.2-17 hIgG1: 0.41±0.07; G9.2-17 mIgG1: 2.91±0.66.
Figure 33A:
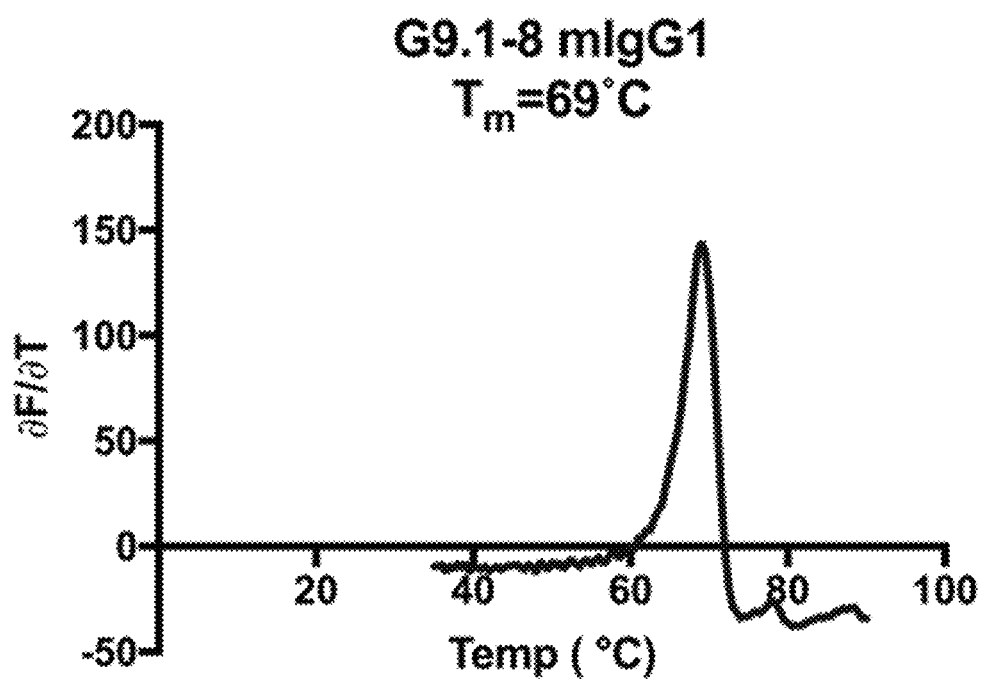
FIGS. 33A and 33B depict graphs showing a thermal stability determination of anti-Galectin-9 antibodies. The first derivative of the fluorescence emission plotted as a function of temperature (−dF/dT). The melting temperature is represented as the temperature at which a peak is observed. Thermal transition was determined using change in binding of fluorophor SYPRO Orange (ThermoFisher) using a real-time PCR instrument with a heating rate of 1° C. per minute, essentially following a method as described in Vedadi et al., Chemical screening methods to identify ligands that promote protein stability, protein crystallization, and structure determination; Proc Natl Acad Sci USA. 2006 Oct. 24; 103(43):15835-40.
Figure 33B:
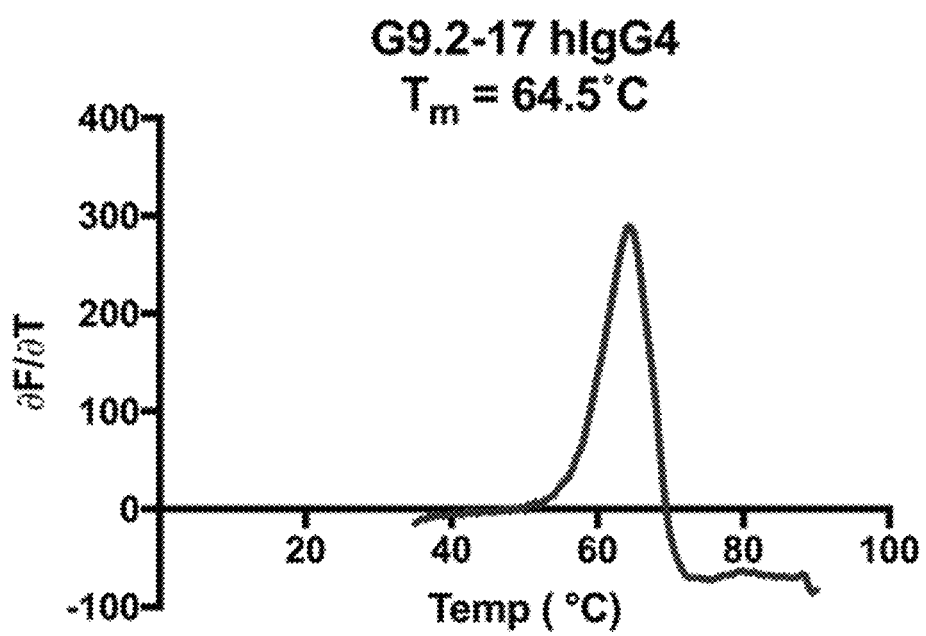

Tumor volumes were taken and animals were weighed three times weekly. The study endpoint was set when the mean tumor volume of the control group (uncensored) reached 1500 mm3. A final tumor volume was taken on the day the study reached endpoint. A final weight was taken on the day the study reached end point (day 10). Tumor volume is shown in FIG. 30 and FIG. 31.

Example 12: Jurkat Apoptosis Assay

Figure 23:
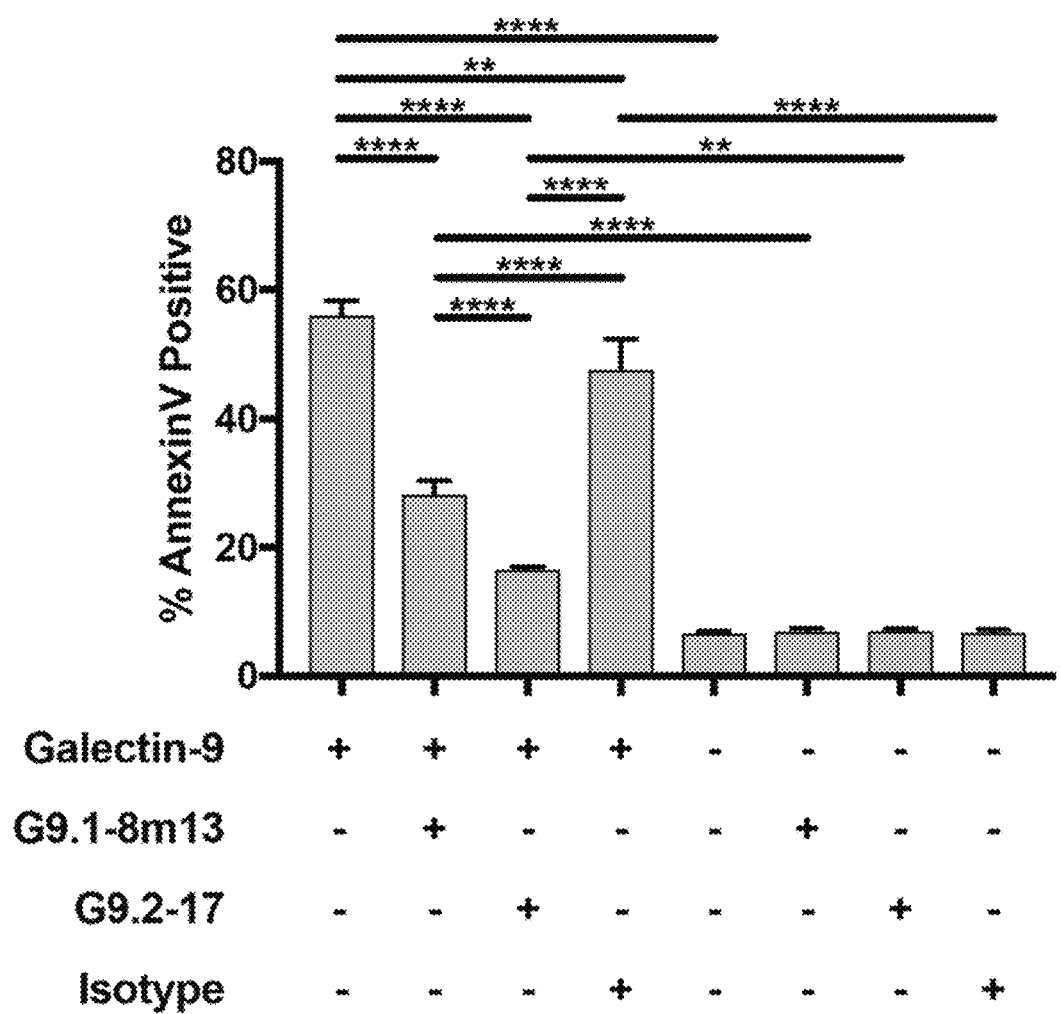
FIG. 23 depicts a graph showing the results of an apoptosis assay demonstrating that Gal-9 antibodies inhibit Galectin-9 induced apoptosis of Jurkat cells. Jurkat cells were treated with or without Galectin-9 (280 nM), G9.2-17 IgG (1 and/or G9.1-8m13 IgG (1 µM) for 6 hours. Cells were then stained with annexin-V and PI followed by flow cytometry analysis. AnnexinV positive cells represent cells in both early and late stage apoptosis. Bars represent average of three replicates, represented as individual data points. Statistical analysis performed by unpaired Student's t-test. (*p<0.05; p<0.01; *p<0.001; ****p<0.0001).

The ability of Galectin-9 G9.2-17 and G9.1-8m9 antibodies to prevent Galectin-9-induced apoptosis of Jurkat cells was assessed. Jurkat cells (TIB-152, ATCC, Manassas, Va.) were grown in modified RPMI (2 mM L-glutamine, 10 mM HEPES, 1 mM sodium pyruvate, 4.5 g/L glucose, 1.5 g/L sodium bicarbonate) with 10% FBS, 100 mU/mL penicillin and 100 µg/mL streptomycin at 37° C. with 5% $CO_2$. Cells ($2 \times 10^5$ cells/well) were incubated in the wells of a 96-well culture plate with or without the addition of 280 nM Galectin-9 (2045-GA, RnD Systems, Minneapolis, Minn.), 1 µM G9.2-17 IgG, and/or 1 µM G9.1-8m9 IgG. Cells were incubated at 37° C., 5% $CO_2$ for 5 hours and then resuspended in annexinV-binding buffer. Cells were then stained with AnnexinV-AlexaFluor488 (Invitrogen, Carlsbad, Calif.) at 4° C. for 30 minutes in the dark. Prior to flow cytometry, propidium iodide (PI) was added (1 µg/mL). Cells were run on Guava easyCyte flow cytometer (MilliporeSigma, Burlington, Mass.) and analyzed using FlowJo (Treestar, Ashland, Oreg.). Cell population was gated via forward and side scatter, then analyzed on AnnexinV for all apoptotic cells and PI for late apoptotic cell populations. Results are shown in FIG. 23.

Example 13. Anti-Galectin-9 Antibodies Disrupt the Interaction Between Galectin-9 and CD206

Microlon high binding 96 well plates (Greiner Bio-One, Kremsmünster, Austria) were coated with hGalectin-9 (RnD Systems, Minneapolis, Minn.) (50 µL, 4 µg/mL in TBS) at room temperature for 1 hour. Plates were then blocked with TBS+0.5% BSA (150 µL) at room temperature for 1 hour. Wells were washed three times with TBS+0.1% BSA. G9.1-8m13, and/or G9.2-17 antibodies were added to each well (50 µL, 100 nM in TBS+0.1% BSA) and incubated at room temperature for 30 minutes. CD206-His (RnD Systems, Minneapolis, Minn.) was then spiked in to a final concentration of 13 nM and incubated for an additional 30 minutes at room temperature. Wells were then washed 3 times with TBS+0.05% Tween20. aHis-HRP (ab1187, Abcam, Cambridge, Mass.) was added to each well (50 µL, 1:2500 in TBS+0.05% Tween20, 0.1% BSA) and incubated an additional 30 minutes at room temperature. Wells were washed three times with TBS+0.05% Tween20 and once with TBS. 1Step TMB-Ultra ELISA substrate (Thermofisher, Waltham, Mass.) (50 µL) was added to each well.

Figure 24:
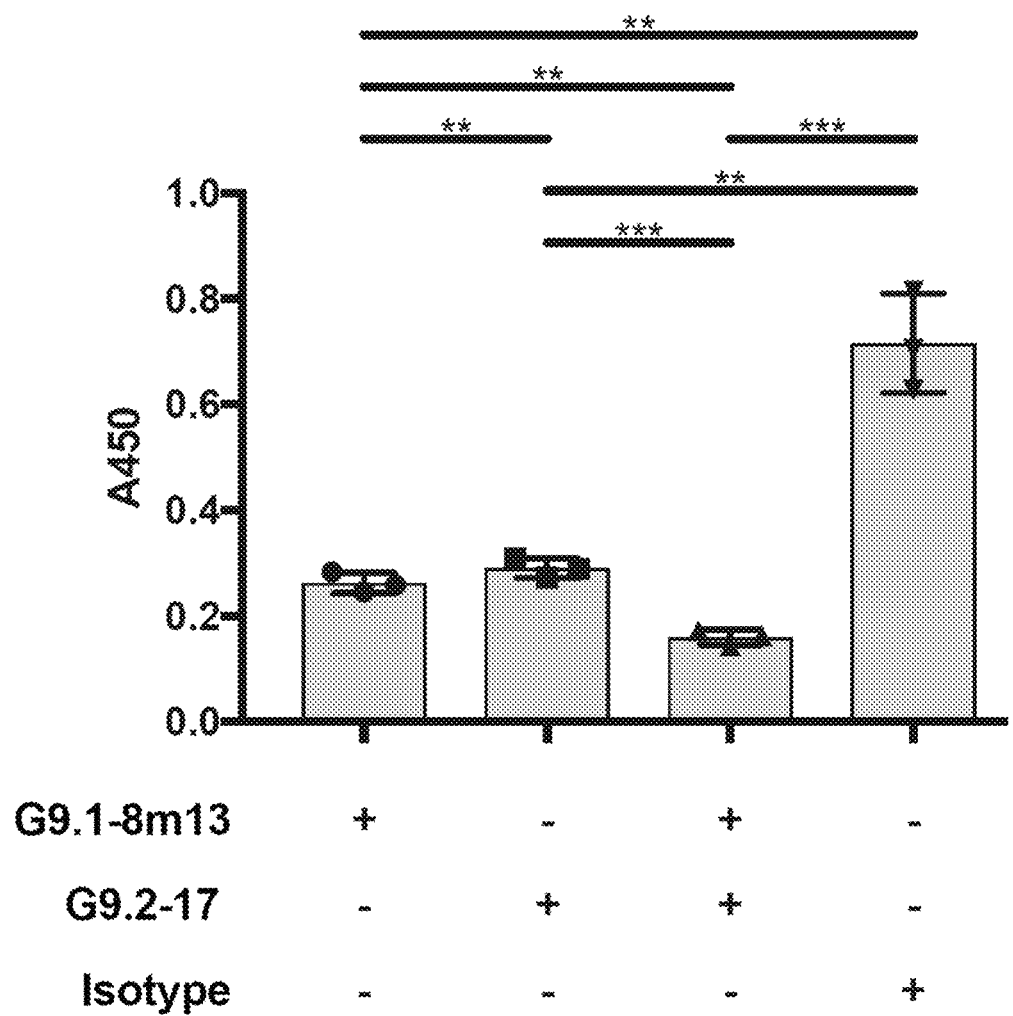
FIG. 24 depicts a graph showing the readout of assays demonstrating anti-Galectin-9 antibodies disclosed herein disrupt the interaction between Galectin-9 and CD206.

The reaction was neutralized with 2M H2504 (50 µL) and absorbance signal at 450 nm was read using an Epoch2 spectrophotometer (BioTek, Winooski, Vt.). Experiments were performed in triplicate; *$p<0.05$; $p<0.01$; *$p<0.001$; ****$p<0.0001$; by unpaired Student's t-test). Results are shown in FIG. 24A and FIG. 24B and indicate that both G9.1-8m13 and G9.2-17 antibodies inhibit the interaction between Galectin-9 and CD206 and their effects are additive.

Example 14. Evaluation of Cytotoxic Activity

To evaluate complement-induced cytotoxic activity of 9.1-8mut13 and 9.2-17, complement-dependent cytotoxicity (CDC) assays are performed and compared with 2 mouse monoclonal antibodies (mouse monoclonal forms of g9.2-17 and g9.1-8m9). Antibodies are incubated with the appropriate target cells expressing either gal-9, and species-specific serum is added as a source of complement proteins to bind to the cell-bound monoclonal antibodies and initiate complement-dependent cytolysis of the target cell. Cell death of target cells is determined by the differential staining obtained in cells with permeable vs. non-permeable membranes (i.e., lysed vs. unlysed cells) after incubation with a fluorescent cell viability dye and assessed by flow cytometry.

Example 15: Evaluation of Gal-9 Antibody in Two Syngeneic Models of Colorectal and Melanoma Cancer in Immunocompetent Mice Gal-9 antibodies G9.2-17 and G9.1-8m13 are evaluated in syngeneic models of colorectal and melanoma cancer in immunocompetent mice. Test articles are formulated and prepared on a weekly basis for the duration of the study according to Table 13.

TABLE 13

| | Test articles | | | | |
|---|---|---|---|---|---|
| Agent | Master Stock Storage | Master Stock Stability | State | Working Stock Storage | Working Stock Stability |
| Control mIgG1 | 4° C., Dark | For the duration of study | Liquid | 4° C., Dark | For the duration of study |
| Control mIgG2 | 4° C., Dark | For the duration of study | Liquid | 4° C., Dark | For the duration of study |
| Gal9-IgG1 (G9.2-17) | −80° C. | For the duration of study | Liquid | −20° C. | For the duration of study |
| Gal9-IgG2 (G9.2-17) | −80° C. | For the duration of study | Liquid | −20° C. | For the duration of study |
| Gal9-IgG1 (G9.1-8m13) | −80° C. | For the duration of study | Liquid | −20° C. | For the duration of study |
| mGal9-IgG2 (G9.1-8m13) | −80° C. | For the duration of study | Liquid | −20° C. | For the duration of study |
| anti-mPD-1 | 4° C., Dark | For the duration of study | Liquid | 4° C., Dark | For the duration of study |

Vehicle Control: mGal9-IgG1, and mGal9-IgG2; Control mIgG1, Control mIgG2, and anti-mPD-1: Sterile PBS Experimental Design Pre-study animals (female C57BL/6, 6-8 weeks of age (Charles River Labs) are acclimatized for 3 days and then are unilaterally implanted subcutaneously on the left flank with 5e5 B16.F10 (melanoma cell line) or MC38 cells (colorectal cancer cell line) resuspended in 100 µl PBS. Pre-study tumor volumes are recorded for each experiment beginning 2-3 days after implantation. When tumors reach an average tumor volume of 50-100 mm³ (preferably 50-75 mm³) animals are matched by tumor volume into treatment or control groups to be used for dosing and dosing initiated on Day 0. The study design for testing of Anti-Gal9 IgG1 and Anti-Gal9 IgG2 is summarized in Table 14 and Table 15.

TABLE 14

Anti-Gal9 IgG1 (B16F10 and MC38)

| Group | -n- | Test Agent | Dose (ug/mouse) | Dose Volume | Route of Administration (ROA) | Schedule | Total Number of Doses |
|---|---|---|---|---|---|---|---|
| 1 | 8 | Control Untreated | — | — | — | — | — |
| 2 | 8 | Control mIgG1 | 200 ug | 200 ul | IV | Q4Dx6 | 6 |
| 3 | 8 | Control mIgG1 | 400 ug | 200 ul | IV | Q4Dx6 | 6 |
| 4 | 8 | Control mIgG2 | 200 ug | 200 ul | IP | BIWx4 | 8 |
| 5 | 8 | Anti-Gal9 mIgG1 | 200 ug | 200 ul | IV | Q4Dx6 | 6 |
| 6 | 8 | Anti-Gal9 mIgG1 | 400 ug | 200 ul | IV | Q4Dx6 | 6 |
| 7 | 8 | Anti-Gal9 mIgG1 (G9.1-8m13) | 200 ug | 200 ul | IV | Q4Dx6 | 6 |
| 8 | 8 | Anti-Gal9 mIgG1 (G9.1-8m13) | 400 ug | 200 ul | IV | Q4Dx6 | 6 |
| 9 | 8 | Anti-Gal9 mIgG1 + mAnti-PD1 | 200 ug / 200 ug | 200 ul / 200 ul | IV / IP | Q4Dx6 / BIWx4 | 6 / 8 |
| 10 | 8 | Anti-Gal9 mIgG1 + mAnti-PD1 | 400 ug / 200 ug | 200 ul / 200 ul | IV / IP | Q4Dx6 / BIWx4 | 6 / 8 |
| 11 | 8 | Anti-Gal9 mIgG1 (G9.1-8m13) + mAnti-PD1 | 200 ug / 200 ug | 200 ul / 200 ul | IV / IP | Q4Dx6 / BIWx4 | 6 / 8 |
| 12 | 8 | Anti-Gal9 mIgG1 (G9.1-8m13) + mAnti-PD1 | 400 ug / 200 ug | 200 ul / 200 ul | IV / IP | Q4Dx6 / BIWx4 | 6 / 8 |
| 13 | 8 | mAnti-PD1 | 200 ug | 200 ul | IP | BIWx4 | 8 |

TABLE 15

Anti-Gal9 IgG2 (B16F10 and MC38)

| Group | -n- | Test Agent | Dose (ug/mouse) | Dose Volume | Route of Administration (ROA) | Schedule | Total Number of Doses |
|---|---|---|---|---|---|---|---|
| 1 | 10 | Control Untreated | — | — | — | — | — |
| 2 | 10 | Control mIgG2 | 200 ug | 200 ul | IV | Q4Dx6 | 6 |
| 3 | 10 | Control mIgG2 | 400 ug | 200 ul | IV | Q4Dx6 | 6 |
| 4 | 10 | Control mIgG2 | 200 ug | 200 ul | IP | BIWx4 | 8 |
| 5 | 10 | Anti-Gal9 mIgG2 | 200 ug | 200 ul | IV | Q4Dx6 | 6 |
| 6 | 10 | Anti-Gal9 mIgG2 | 400 ug | 200 ul | IV | Q4Dx6 | 6 |
| 5 | 10 | Anti-Gal9 mIgG2 (G9.1-8m13) | 200 ug | 200 ul | IV | Q4Dx6 | 6 |
| 6 | 10 | Anti-Gal9 mIgG2 (G9.1-8m13) | 400 ug | 200 ul | IV | Q4Dx6 | 6 |
| 7 | 10 | Anti-Gal9 mIgG2 + mAnti-PD1 | 200 ug / 200 ug | 200 ul / 200 ul | IV / IP | Q4Dx6 / BIWx4 | 6 / 8 |
| 8 | 10 | Anti-Gal9 mIgG2 + mAnti-PD1 | 400 ug / 200 ug | 200 ul / 200 ul | IV / IP | Q4Dx6 / BIWx4 | 6 / 8 |
| 7 | 10 | Anti-Gal9 mIgG2 (G9.1-8m13) + mAnti-PD1 | 200 ug / 200 ug | 200 ul / 200 ul | IV / IP | Q4Dx6 / BIWx4 | 6 / 8 |
| 8 | 10 | Anti-Gal9 mIgG2 (G9.1-8m13) + mAnti-PD1 | 400 ug / 200 ug | 200 ul / 200 ul | IV / IP | Q4Dx6 / BIWx4 | 6 / 8 |
| 9 | 10 | mAnti-PD1 | 200 ug | 200 ul | IP | BIWx4 | 8 |

Tumor volumes are taken three times weekly. A final tumor volume is taken on the day the study reaches endpoint. A final tumor volume is taken if an animal is found moribund. Animals are weighed three times weekly. A final weight is taken on the day the study reaches end point or if animal is found moribund. Animals exhibiting ≥10% weight loss when compared to Day 0 are provided DietGel® ad libitum. Any animal exhibiting >20% net weight loss for a period lasting 7 days or if mice display >30% net weight loss when compared to Day 0 is considered moribund and is euthanized. The study endpoint is set when the mean tumor volume of the control group (uncensored) reaches 1500 mm3. If this occurs before Day 28, treatment groups and individual mice are dosed and measured up to Day 28. If the mean tumor volume of the control group (uncensored) does not reach 1500 mm3 by Day 28, then the endpoint for all animals is the day when the mean tumor volume of the control group (uncensored) reaches 1500 mm3 up to a maximum of Day 60. Blood is collected from all animals from each group. For blood collection, as much blood as possible is collected via a cardiac puncture into $K_2$EDTA tubes (400 ul) and serum separator tubes (remaining) under deep anesthesia induced by isoflurane inhalation. The blood collected into $K_2$EDTA tubes is placed on wet ice until used for performing immune panel flow as shown in Table 16.

TABLE 16

Flow Cytometry Panel 1

| Antibody Description | Conjugate | Clone | Supplier |
|---|---|---|---|
| mCD3 | FITC | 17A2 | BioLegend |
| mCD4 | APC-Fire 750 | RM4-4 | BioLegend |
| mGamma Delta | BV605 | GL3 | BioLegend |
| mCD8 | APC-R700 | 53-6.7 | BioLegend |
| mCD44 | BV786 | IM7 | BioLegend |
| mCD11b | APC | M1/70 | BioLegend |
| mCD45 | BV510 | 30-F11 | BioLegend |
| Live Dead | 7AAD | — | BioLegend |
| mCD62L | PE-Cy7 | MEL-14 | BioLegend |
| mPD-1 | BV711 | 29F.1A12 | BioLegend |
| mCTLA4 | PE | UC10-4B9 | BioLegend |
| mCD27 | BV421 | LG.3A10 | BioLegend |

Blood collected into serum separator tubes is allowed to clot at room temperature for at least 15 minutes. Samples are centrifuged at 3500 for 10 minutes at room temperature. The resultant serum is separated, transferred to uniquely labeled clear polypropylene tubes, and frozen immediately over dry ice or in a freezer set to maintain −80° C. until shipment for the bridging ADA assay (shipped within one week).

Tumors from all animals are collected as follows. Tumors less than 400 mm$^3$ in size are snap frozen, placed on dry ice, and stored at −80C until used for RT-qPCR analysis. For tumors of 400-500 mm$^3$ in size, whole tumors are collected into MACS media for use in the Flow Panel (shown in Table 16A below). For tumors greater than 500 mm$^3$ in size, a small piece (about 50 mm$^3$) is snap frozen placed on dry ice, and stored at −80C for RT-qPCR, and the remaining tumor is collected in MACS media for flow cytometry (as shown in Table 16A). For flow cytometry, tumors are placed in MACS media and stored on wet ice until processed. A summary of the flow cytometry analysis performed is shown in Table 16A.

TABLE 16A

Flow cytometry Panel 2

| Antibody Description | Conjugate | Clone | Supplier |
|---|---|---|---|
| mCD3 | FITC | 17A2 | BioLegend |
| mCD4 | APC-Fire 750 | RM4-4 | BioLegend |
| mGamma Delta | BV605 | GL3 | BioLegend |
| mCD8 | APC-R700 | 53-6.7 | BioLegend |
| mCD69 | BV421 | H1.2F3 | BioLegend |
| mCD11b | APC | M1/70 | BioLegend |
| mCD45 | BV510 | 30-F11 | BioLegend |
| Live Dead | 7AAD | — | BioLegend |
| mCD62L | PE-Cy7 | MEL-14 | BioLegend |
| mPD-1 | BV711 | 29F.1A12 | BioLegend |
| mCTLA4 | PE | UC10-4B9 | BioLegend |
| mNk1.1 | BV786 | PK136 | BioLegend |

Spleen, liver, colon, lungs, heart, and kidneys from all animals are retained in 10% neutral buffered formalin (NBF) for 18-24 hours, transferred to 70% ethanol and stored at room temperature. Formalin fixed samples are paraffin embedded.

Example 16: Evaluation of Gal-9 Antibody in a Models of Cholangiocarcinoma

The efficacy of Gal-9 antibody is assessed in a mouse model of cholangiocarcinoma as described in S. Rizvi, et al. (YAP-associated chromosomal instability and cholangiocarcinoma in mice, Oncotarget, 9 (2018) 5892-5905), the contents of which is herein incorporated by reference in its entirety. In this transduction model, in which oncogenes (AKT/YAP) are instilled directly into the biliary tree, tumors arise from the biliary tract in immunocompetent hosts with species-matched tumor microenvironment. Dosing is described in Table 17.

TABLE 17

Dosing

| Group | -n- | Test Agent | Dose (ug/mouse) | Dose Volume | Route of Administration (ROA) | Schedule | Total Number of Doses |
|---|---|---|---|---|---|---|---|
| 1 | 10 | Control Untreated | — | — | — | — | — |
| 2 | 10 | Control mIgG2 | 200 ug | 200 ul | IV | Q4Dx6 | 6 |
| 3 | 10 | Control mIgG2 | 400 ug | 200 ul | IV | Q4Dx6 | 6 |
| 4 | 10 | Control mIgG2 | 200 ug | 200 ul | IP | BIWx4 | 8 |
| 5 | 10 | Anti-Gal9 mIgG2 (G9.2-17) | 200 ug | 200 ul | IV | Q4Dx6 | 6 |
| 6 | 10 | Anti-Gal9 mIgG2 (G9.2-17) | 400 ug | 200 ul | IV | Q4Dx6 | 6 |
| 7 | 10 | Anti-Gal9 mIgG2 (G9.1.8-m13) | 200 ug | 200 ul | IV | Q4Dx6 | 6 |
| 8 | 10 | Anti-Gal9 mIgG2 (G9.1.8-m13) | 400 ug | 200 ul | IV | Q4Dx6 | 6 |

In brief, murine CCA cells (described in S. Rizvi, et al) are harvested and washed in DMEM. Male C57BL/6 mice from Jackson Labs are anesthetized using 1.5-3% isoflurane. Under deep anesthesia, the abdominal cavity is opened by a 1 cm incision below the xiphoid process. A sterile cotton tipped applicator is used to expose the superolateral aspect of the medial lobe of the liver. Using a 27-gauge needle, 40 µL of standard media containing 1×10^6 cells is injected into the lateral aspect of the medial lobe. Cotton tipped applicator is held over the injection site to prevent cell leakage and blood loss. Subsequently, the abdominal wall and skin are closed in separate layers with absorbable chromic 3-0 gut suture material.

Two weeks post implantation, animals are matched by tumor volume into treatment or control groups to be used for dosing and dosing initiated on Day 0. Tumor volumes are measured and animals weighed three times weekly. A final tumor volume and weight is taken on the day the study reaches endpoint (4 weeks or when tumor burden of control becomes 1500 mm3). Blood is collected from all animals from each group. Tumors from all animals are collected essentially as described in Example 15. Analysis is performed essentially as described in Example 15.

EQUIVALENTS

From the above description, one skilled in the art can easily ascertain the essential characteristics of the present invention, and without departing from the spirit and scope thereof, can make various changes and modifications of the invention to adapt it to various usages and conditions. Thus, other embodiments are also within the claims.

While several inventive embodiments have been described and illustrated herein, those of ordinary skill in the art will readily envision a variety of other means and/or structures for performing the function and/or obtaining the results and/or one or more of the advantages described herein, and each of such variations and/or modifications is deemed to be within the scope of the inventive embodiments described herein. More generally, those skilled in the art will readily appreciate that all parameters, dimensions, materials, and configurations described herein are meant to be exemplary and that the actual parameters, dimensions, materials, and/or configurations will depend upon the specific application or applications for which the inventive teachings is/are used. Those skilled in the art will recognize, or be able to ascertain using no more than routine experimentation, many equivalents to the specific inventive embodiments described herein. It is, therefore, to be understood that the foregoing embodiments are presented by way of example only and that, within the scope of the appended claims and equivalents thereto, inventive embodiments may be practiced otherwise than as specifically described and claimed. Inventive embodiments of the present disclosure are directed to each individual feature, system, article, material, kit, and/or method described herein. In addition, any combination of two or more such features, systems, articles, materials, kits, and/or methods, if such features, systems, articles, materials, kits, and/or methods are not mutually inconsistent, is included within the inventive scope of the present disclosure.

All definitions, as defined and used herein, should be understood to control over dictionary definitions, definitions in documents incorporated by reference, and/or ordinary meanings of the defined terms.

All references, patents and patent applications disclosed herein are incorporated by reference with respect to the subject matter for which each is cited, which in some cases may encompass the entirety of the document.

The indefinite articles "a" and "an," as used herein in the specification and in the claims, unless clearly indicated to the contrary, should be understood to mean "at least one."

The phrase "and/or," as used herein in the specification and in the claims, should be understood to mean "either or both" of the elements so conjoined, i.e., elements that are conjunctively present in some cases and disjunctively present in other cases. Multiple elements listed with "and/or" should be construed in the same fashion, i.e., "one or more" of the elements so conjoined. Other elements may optionally be present other than the elements specifically identified by the "and/or" clause, whether related or unrelated to those elements specifically identified. Thus, as a non-limiting example, a reference to "A and/or B", when used in conjunction with open-ended language such as "comprising" can refer, in one embodiment, to A only (optionally including elements other than B); in another embodiment, to B only (optionally including elements other than A); in yet another embodiment, to both A and B (optionally including other elements); etc.

As used herein in the specification and in the claims, "or" should be understood to have the same meaning as "and/or" as defined above. For example, when separating items in a list, "or" or "and/or" shall be interpreted as being inclusive, i.e., the inclusion of at least one, but also including more than one, of a number or list of elements, and, optionally, additional unlisted items. Only terms clearly indicated to the contrary, such as "only one of" or "exactly one of," or, when used in the claims, "consisting of," will refer to the inclusion of exactly one element of a number or list of elements. In general, the term "or" as used herein shall only be interpreted as indicating exclusive alternatives (i.e., "one or the other but not both") when preceded by terms of exclusivity, such as "either," "one of," "only one of," or "exactly one of." "Consisting essentially of," when used in the claims, shall have its ordinary meaning as used in the field of patent law.

As used herein in the specification and in the claims, the phrase "at least one," in reference to a list of one or more elements, should be understood to mean at least one element selected from any one or more of the elements in the list of elements, but not necessarily including at least one of each and every element specifically listed within the list of elements and not excluding any combinations of elements in the list of elements. This definition also allows that elements may optionally be present other than the elements specifically identified within the list of elements to which the phrase "at least one" refers, whether related or unrelated to those elements specifically identified. Thus, as a non-limiting example, "at least one of A and B" (or, equivalently, "at least one of A or B," or, equivalently "at least one of A and/or B") can refer, in one embodiment, to at least one, optionally including more than one, A, with no B present (and optionally including elements other than B); in another embodiment, to at least one, optionally including more than one, B, with no A present (and optionally including elements other than A); in yet another embodiment, to at least one, optionally including more than one, A, and at least one, optionally including more than one, B (and optionally including other elements); etc.

It should also be understood that, unless clearly indicated to the contrary, in any methods claimed herein that include more than one step or act, the order of the steps or acts of the method is not necessarily limited to the order in which the steps or acts of the method are recited.

SEQUENCE LISTING (468 sequences)

SEQ ID NO: 1 - protein, 355 aa, Homo sapiens
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQNPRTVPVQPAFSTVPFSQPVCFPPRPRGRRQKPPGVWPANPAPITQTVIHTVQSAPGQMFSTPAIPPMMYPHPAYPMPFITTILGGLYPSKSILLSGTVLPSAQRFHINLCSGNHIAFHLNPRFDENAVVRNTQIDNSWGSEERSLPRKMPFVRGQSFSVWILCEAHCLKVAVDGQHLFEYYHRLRNLPTINRLEVGGDIQLTHVQT

SEQ ID NO: 2 - protein, 293 aa, Mus musculus
MALFSAQSPYINPIIPFTGPIQGGLQEGLQVTLQGTTKSFAQRFVVNFQNSFNGNDIAFHFNPRFEEGGYVVCNTKQNGQWGPEERKMQMPFQKGMPFELCFLVQRSEFKVMVNKKFFVQYQHRVPYHLVDTIAVSGCLKLSFITFQNSAAPVQHVFSTLQFSQPVQFPRTPKGRKQKTQNFRPAHQAPMAQTTIHMVHSTPGQMFSTPGIPPVVYPTPAYTIPFYTPIPNGLYPSKSIMISGNVLPDATRFHINLRCGGDIAFHLNPRFNENAVVRNTQINNSWGQEERSLL

SEQ ID NO: 3 - protein, 149 aa, Homo sapiens
MAFSGSQAPYLSPAVPFSGTIQGGLQDGLQITVNGTVLSSSGTRFAVNFQTGFSGNDIAFHFNPRFEDGGYVVCNTRQNGSWGPEERKTHMPFQKGMPFDLCFLVQSSDFKVMVNGILFVQYFHRVPFHRVDTISVNGSVQLSYISFQN

SEQ ID NO: 4 - protein, 138 aa, Homo sapiens
YPHPAYPMPFITTILGGLYPSKSILLSGTVLPSAQRFHINLCSGNHIAFHLNPRFDENAVVRNTQIDNSWGSEERSLPRKMPFVRGQSFSVWILCEAHCLKVAVDGQHLFEYYHRLRNLPTINRLEVGGDIQLTHVQT

SEQ ID NO: 5 - protein, 147 aa, Mus musculus
MALFSAQSPYINPIIPFTGPIQGGLQEGLQVTLQGTTKSFAQRFVVNFQNSFNGNDIAFHFNPRFEEGGYVVCNTKQNGQWGPEERKMQMPFQKGMPFELCFLVQRSEFKVMVNKKFFVQYQHRVPYHLVDTIAVSGCLKLSFITFQ

SEQ ID NO: 6 - protein, 68 aa, Mus musculus
YTPIPNGLYPSKSIMISGNVLPDATRFHINLRCGGDIAFHLNPRFNENAVVRNTQINNSWGQEERSLL

SEQ ID NO: 7 - protein, 109 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQSWVGSLITFGQGTKVEIKR

SEQ ID NO: 8 - protein, 127 aa, Artificial Sequence
  Synthetic Polypeptide
EVQLVESGGGLVQPGGSLRLSCAASGFTFSSSSIHWVRQAPGKGLEWVASIYSSYGYTYYADSVKGRFTISADTSKNTAYLQMNSLRAEDTAVYYCARYYWGWSQNQGFWWYGLDYWGQGTLVTVSS

SEQ ID NO: 9 - protein, 110 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQWQWGYSLVTFGQGTKVEIKR

SEQ ID NO: 10 - protein, 123 aa, Artificial Sequence
  Synthetic Polypeptide
EVQLVESGGGLVQPGGSLRLSCAASGFTISSSSIHWVRQAPGKGLEWVASISSYYGSTYYADSVKGRFTISADTSKNTAYLQMNSLRAEDTAVYYCARSWSSSFWYNWALDYWGQGTLVTVSS

SEQ ID NO: 11 - protein, 110 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQSWYSNKPITFGQGTKVEIKR

SEQ ID NO: 12 - protein, 125 aa, Artificial Sequence
  Synthetic Polypeptide
EVQLVESGGGLVQPGGSLRLSCAASGFTIYSSSIHWVRQAPGKGLEWVAYIYSSSGYTSYADSVKGRFTISADTSKNTAYLQMNSLRAEDTAVYYCARYSHSSLYYSWIWALDYWGQGTLVTVSS

SEQ ID NO: 13 - protein, 108 aa, Artificial Sequence [sequence omitted]

SEQ ID NO: 14 - protein, 123 aa, Artificial Sequence
  Synthetic Polypeptide
EVQLVESGGGLVQPGGSLRLSCAASGFTIYYSSIHWVRQAPGKGLEWVASISSSSGSTSYADSVKGRFTISADTSKNTAYLQMNSLRAEDTAVYYCARSYRPYSSYYWGMDYWGQGTLVTVSS

SEQ ID NO: 15 - protein, 110 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQYYGWFYPVTFGQGTKVEIKR

SEQ ID NO: 16 - protein, 128 aa, Artificial Sequence
  Synthetic Polypeptide
EVQLVESGGGLVQPGGSLRLSCAASGFTIYYSSIHWVRQAPGKGLEWVASISSSYGSTYYADSVKGRFTISADTSKNTAYLQMNSLRAEDTAVYYCARSVSWYPYYYYYGYGSGLDYWGQGTLVTVSS

SEQ ID NO: 17 - protein, 108 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQYHSSLFTFGQGTKVEIKR

SEQ ID NO: 18 - protein, 128 aa, Artificial Sequence
  Synthetic Polypeptide
EVQLVESGGGLVQPGGSLRLSCAASGFTLSSSSIHWVRQAPGKGLEWVASIYSSYGSTSYADSVKGRFTISADTSKNTAYLQMNSLRAEDTAVYYCARSSHWYMYWSYWGWYIGMDYWGQGTLVTVSS

SEQ ID NO: 19 - protein, 110 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQYPGYRGLITFGQGTKVEIKR

SEQ ID NO: 20 - protein, 126 aa, Artificial Sequence
  Synthetic Polypeptide
EVQLVESGGGLVQPGGSLRLSCAASGFTVSSSSIHWVRQAPGKGLEWVASISSYYGYTYYADSVKGRFTISADTSKNTAYLQMNSLRAEDTAVYYCARSYSYGYDYFVKYYTMDYWGQGTLVTVSS

SEQ ID NO: 21 - protein, 110 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQSYYDSNPITFGQGTKVEIKR

SEQ ID NO: 22 - protein, 127 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSWGGIGKWVWGMDYWGQGTLVTVSS

SEQ ID NO: 23 - protein, 110 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQSYFHKIPITFGQGTKVEIKR

SEQ ID NO: 24 - protein, 124 aa, Artificial Sequence
  Synthetic Polypeptide
EVQLVESGGGLVQPGGSLRLSCAASGFTVSSSSIHWVRQAPGKGLEWVAYIYSSSGYTSYADSVKGRFTISADTSKNTAYLQMNSLRAEDTAVYYCARYSSYHYPYWLFAMDYWGQGTLVTVSS

SEQ ID NO: 25 - protein, 109 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQWYWYYPVTFGQGTKVEIKR

SEQ ID NO: 26 - protein, 129 aa, Artificial Sequence
  Synthetic Polypeptide
EVQLVESGGGLVQPGGSLRLSCAASGFTVSYSSIHWVRQAPGKGLEWVASIYSYYGSTYYADSVKGRFTISADTSKNTAYLQMNSLRAEDTAVYYCARGHYQEGRKSGFSYWSPALDYWGQGTLVTVSS

SEQ ID NO: 27 - protein, 108 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQTYWGLITFGQGTKVEIKR

SEQ ID NO: 28 - protein, 130 aa, Artificial Sequence
  Synthetic Polypeptide
EVQLVESGGGLVQPGGSLRLSCAASGFTVYSSSIHWVRQAPGKGLEWVASIYSYYGYTSYADSVKGRFTISADTSKNTAYLQMNSLRAEDTAVYYCARSTEGYDRWGYYSSYWSSGLDYWGQGTLVTVSS

SEQ ID NO: 29 - protein, 20 aa, Artificial Sequence
  Synthetic Polypeptide
MYRMQLLSCIALSLALVTNS

SEQ ID NO: 30 - protein, 127 aa, Artificial Sequence
  Synthetic Polypeptide
EVQLVESGGGLVQPGGSLRLSCAASGFTLYSSSIHWVRQAPGKGLEWVASIYSSSGYTYYADSVKGRFTISADTSKNTAYLQMNSLRAEDTAVYYCARTYTWKSSWSYQTGYGLDYWGQGTLVTVSS

SEQ ID NO: 31 - protein, 129 aa, Artificial Sequence
  Synthetic Polypeptide
EVQLVESGGGLVQPGGSLRLSCAASGFTFSSSSIHWVRQAPGKGLEWVASISPYYGSTYYADSVKGRFTISADTSKNTAYLQMNSLRAEDTAVYYCARAVYYYVYNRSWYWWSGGFDYWGQGTLVTVSS

SEQ ID NO: 32 - protein, 126 aa, Artificial Sequence
  Synthetic Polypeptide
EVQLVESGGGLVQPGGSLRLSCAASGFTFSSSSIHWVRQAPGKGLEWVASISSSSGSTSYADSVKGRFTISADTSKNTAYLQMNSLRAEDTAVYYCARPAYSYPYYYFHYGAMDYWGQGTLVTVSS

SEQ ID NO: 33 - protein, 125 aa, Artificial Sequence
  Synthetic Polypeptide
EVQLVESGGGLVQPGGSLRLSCAASGFTFSSSSIHWVRQAPGKGLEWVASIYPSYGYTSYADSVKGRFTISADTSKNTAYLQMNSLRAEDTAVYYCARAWYHHEYWGHYSGMDYWGQGTLVTVSS

SEQ ID NO: 34 - protein, 108 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQSSWGLITFGQGTKVEIKR

SEQ ID NO: 35 - protein, 125 aa, Artificial Sequence
  Synthetic Polypeptide
EVQLVESGGGLVQPGGSLRLSCAASGFTFSSSSIHWVRQAPGKGLEWVASIYSSYGSTYYADSVKGRFTISADTSKNTAYLQMNSLRAEDTAVYYCARSGYSHPYYSYYSGMDYWGQGTLVTVSS

SEQ ID NO: 36 - protein, 109 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQFWGSKLFTFGQGTKVEIKR

SEQ ID NO: 37 - protein, 127 aa, Artificial Sequence
  Synthetic Polypeptide
EVQLVESGGGLVQPGGSLRLSCAASGFTFSSSSIHWVRQAPGKGLEWVASIYSYSGYTYYADSVKGRFTISADTSKNTAYLQMNSLRAEDTAVYYCARTYMAGYKYYFISGYGFDYWGQGTLVTVSS

SEQ ID NO: 38 - protein, 110 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQMYYPGYLITFGQGTKVEIKR

SEQ ID NO: 39 - protein, 124 aa, Artificial Sequence
  Synthetic Polypeptide
EVQLVESGGGLVQPGGSLRLSCAASGFTFSYSSIHWVRQAPGKGLEWVASIYPSYGYTYYADSVKGRFTISADTSKNTAYLQMNSLRAEDTAVYYCARYWDYGWMYFDPAMDYWGQGTLVTVSS

SEQ ID NO: 40 - protein, 109 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQDRWWSALTFGQGTKVEIKR

SEQ ID NO: 41 - protein, 124 aa, Artificial Sequence
  Synthetic Polypeptide
EVQLVESGGGLVQPGGSLRLSCAASGFTFSYSSIHWVRQAPGKGLEWVASIYSYSGYTSYADSVKGRFTISADTSKNTAYLQMNSLRAEDTAVYYCARYMENWEWPYHSAMDYWGQGTLVTVSS

SEQ ID NO: 42 - protein, 110 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQSYGSWYPITFGQGTKVEIKR

SEQ ID NO: 43 - protein, 130 aa, Artificial Sequence
  Synthetic Polypeptide
EVQLVESGGGLVQPGGSLRLSCAASGFTFYSSSIHWVRQAPGKGLEWVASIYSSYGSTYYADSVKGRFTISADTSKNTAYLQMNSLRAEDTAVYYCARSWWYPYWQYYPGGWHSSGFDYWGQGTLVTVSS

SEQ ID NO: 44 - protein, 109 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQGWYASPITFGQGTKVEIKR

SEQ ID NO: 45 - protein, 124 aa, Artificial Sequence
  Synthetic Polypeptide
EVQLVESGGGLVQPGGSLRLSCAASGFTFYSSSIHWVRQAPGKGLEWVAYISPSSGYTSYADSVKGRFTISADTSKNTAYLQMNSLRAEDTAVYYCARYTMTYQYYPSGAMDYWGQGTLVTVSS

SEQ ID NO: 46 - protein, 110 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQYSSHKYPFTFGQGTKVEIKR

SEQ ID NO: 47 - protein, 129 aa, Artificial Sequence
  Synthetic Polypeptide
EVQLVESGGGLVQPGGSLRLSCAASGFTIYSSYIHWVRQAPGKGLEWVASIYSSSGYTYYADSVKGRFTISADTSKNTAYLQMNSLRAEDTAVYYCARSYIYYMWQYNYGMSGYGLDYWGQGTLVTVSS

SEQ ID NO: 48 - protein, 110 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQWVYPGSLITFGQGTKVEIKR

SEQ ID NO: 49 - protein, 125 aa, Artificial Sequence
  Synthetic Polypeptide
EVQLVESGGGLVQPGGSLRLSCAASGFTLSYSSIHWVRQAPGKGLEWVASISSSYGYTYYADSVKGRFTISADTSKNTAYLQMNSLRAEDTAVYYCARHSPYYLHSWWWSGLDYWGQGTLVTVSS

SEQ ID NO: 50 - protein, 123 aa, Artificial Sequence
  Synthetic Polypeptide
EVQLVESGGGLVQPGGSLRLSCAASGFTLYYSSIHWVRQAPGKGLEWVASISPSYGSTSYADSVKGRFTISADTSKNTAYLQMNSLRAEDTAVYYCARHSWYYPYYYYALDYWGQGTLVTVSS

SEQ ID NO: 51 - protein, 123 aa, Artificial Sequence
  Synthetic Polypeptide
EVQLVESGGGLVQPGGSLRLSCAASGFTVSSSSIHWVRQAPGKGLEWVASISSSSGYTYYADSVKGRFTISADTSKNTAYLQMNSLRAEDTAVYYCARYWSYPYVYFLAFDYWGQGTLVTVSS

SEQ ID NO: 52 - protein, 129 aa, Artificial Sequence
  Synthetic Polypeptide
EVQLVESGGGLVQPGGSLRLSCAASGFTVSSSSIHWVRQAPGKGLEWVASIYSSSGYTSYADSVKGRFTISADTSKNTAYLQMNSLRAEDTAVYYCARNVENYPYWAWPWGYYGAIDYWGQGTLVTVSS

SEQ ID NO: 53 - protein, 123 aa, Artificial Sequence
  Synthetic Polypeptide
EVQLVESGGGLVQPGGSLRLSCAASGFTVSSSSIHWVRQAPGKGLEWVASIYSSSGYTYYADSVKGRFTISADTSKNTAYLQMNSLRAEDTAVYYCARTYKWSYYTGYGFDYWGQGTLVTVSS

SEQ ID NO: 54 - protein, 108 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQSSTDPITFGQGTKVEIKR

SEQ ID NO: 55 - protein, 124 aa, Artificial Sequence
  Synthetic Polypeptide
EVQLVESGGGLVQPGGSLRLSCAASGFTVSSSSIHWVRQAPGKGLEWVAYISSSSGYTYYADSVKGRFTISADTSKNTAYLQMNSLRAEDTAVYYCARYWSYPSWWPYRGMDYWGQGTLVTVSS

SEQ ID NO: 56 - protein, 124 aa, Artificial Sequence
  Synthetic Polypeptide
EVQLVESGGGLVQPGGSLRLSCAASGFTVSSSSIHWVRQAPGKGLEWVAYISSSSGYTYYADSVKGRFTISADTSKNTAYLQMNSLRAEDTAVYYCARYWSYPSWSPYRGMDYWGQGTLVTVSS

SEQ ID NO: 57 - protein, 125 aa, Artificial Sequence
  Synthetic Polypeptide
EVQLVESGGGLVQPGGSLRLSCAASGFTVSSYSIHWVRQAPGKGLEWVAYIYSSSGYTSYADSVKGRFTISADTSKNTAYLQMNSLRAEDTAVYYCARVGYYYPYLYLGDGLDYWGQGTLVTVSS

SEQ ID NO: 58 - protein, 109 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQSSQYDLITFGQGTKVEIKR

SEQ ID NO: 59 - protein, 130 aa, Artificial Sequence
  Synthetic Polypeptide
EVQLVESGGGLVQPGGSLRLSCAASGFTVSSYSIHWVRQAPGKGLEWVASISSSSGSTSYADSVKGRFTISADTSKNTAYLQMNSLRAEDTAVYYCARNAWHYEPSYWYGNYATYGFDYWGQGTLVTVSS

SEQ ID NO: 60 - protein, 123 aa, Artificial Sequence
  Synthetic Polypeptide
EVQLVESGGGLVQPGGSLRLSCAASGFTVSYSSIHWVRQAPGKGLEWVASISSSSSSTYYADSVKGRFTISADTSKNTAYLQMNSLRAEDTAVYYCARGQQYYPDQYWGLDYWGQGTLVTVSS

SEQ ID NO: 61 - protein, 109 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQSSSSSLFTFGQGTKVEIKR

SEQ ID NO: 62 - protein, 128 aa, Artificial Sequence
  Synthetic Polypeptide
EVQLVESGGGLVQPGGSLRLSCAASGFTVSYSSIHWVRQAPGKGLEWVASIYSSSGYTYYADSVKGRFTISADTSKNTAYLQMNSLRAEDTAVYYCARTYYTYFDWWRTAVYYGFDYWGQGTLVTVSS

SEQ ID NO: 63 - protein, 110 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQRWYPGDLITFGQGTKVEIKR

SEQ ID NO: 64 - protein, 126 aa, Artificial Sequence
  Synthetic Polypeptide
EVQLVESGGGLVQPGGSLRLSCAASGFTVYSSSIHWVRQAPGKGLEWVASISSSYGYTSYADSVKGRFTISADTSKNTAYLQMNSLRAEDTAVYYCARDYYNYMSSYWWYSALDYWGQGTLVTVSS

SEQ ID NO: 65 - protein, 109 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQSYFPSLVTFGQGTKVEIKR

SEQ ID NO: 66 - protein, 128 aa, Artificial Sequence
  Synthetic Polypeptide
EVQLVESGGGLVQPGGSLRLSCAASGFTVYSSSIHWVRQAPGKGLEWVASIYPYYGYTSYADSVKGRFTISADTSKNTAYLQMNSLRAEDTAVYYCARKIFWPVSWMWQGYYPALDYWGQGTLVTVSS

SEQ ID NO: 67 - protein, 108 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQWSQSPVTFGQGTKVEIKR

SEQ ID NO: 68 - protein, 123 aa, Artificial Sequence
  Synthetic Polypeptide
EVQLVESGGGLVQPGGSLRLSCAASGFTVYSSSIHWVRQAPGKGLEWVASIYSSYGYTSYADSVKGRFTISADTSKNTAYLQMNSLRAEDTAVYYCARSYSSETHYGWAMDYWGQGTLVTVSS

SEQ ID NO: 69 - protein, 109 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQSYVYYPFTFGQGTKVEIKR

SEQ ID NO: 70 - protein, 127 aa, Artificial Sequence
  Synthetic Polypeptide
EVQLVESGGGLVQPGGSLRLSCAASGFTLSSSSIHWVRQAPGKGLEWVASIYSSYGSTSYADSVKGRFTISADTSKNTAYLQMNSLRAEDTAVYYCARQYYTYFEWYMGWGYALDYWGQGTLVTVSS

SEQ ID NO: 71 - protein, 110 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQGGWYYGPITFGQGTKVEIKR

SEQ ID NO: 72 - protein, 125 aa, Artificial Sequence
  Synthetic Polypeptide
EVQLVESGGGLVQPGGSLRLSCAASGFTVSSSSIHWVRQAPGKGLEWVAYISSYSGSTYYADSVKGRFTISADTSKNTAYLQMNSLRAEDTAVYYCARSSALYWMDFSYSALDYWGQGTLVTVSS

SEQ ID NO: 73 - protein, 124 aa, Artificial Sequence
  Synthetic Polypeptide
EVQLVESGGGLVQPGGSLRLSCAASGFTVSSSSIHWVRQAPGKGLEWVAYISSSSGYTYYADSVKGRFTISADTSKNTAYLQMNSLRAEDTAVYYCARSSSSSSSSSSSSSDYWGQGTLVTVSS

SEQ ID NO: 74 - protein, 127 aa, Artificial Sequence
  Synthetic Polypeptide
EVQLVESGGGLVQPGGSLRLSCAASGFTVSSSSIHWVRQAPGKGLEWVASSSSSSGYTSYADSVKGRFTISADTSKNTAYLQMNSLRAEDTAVYYCARYSTYSWGGIGKWVWGMDYWGQGTLVTVSS

SEQ ID NO: 75 - protein, 127 aa, Artificial Sequence
  Synthetic Polypeptide
EVQLVESGGGLVQPGGSLRLSCAASGFTVSSSSIHWVRQAPGKGLEWVAYIYPYSSSSSYADSVKGRFTISADTSKNTAYLQMNSLRAEDTAVYYCARYSTYSWGGIGKWVWGMDYWGQGTLVTVSS

SEQ ID NO: 76 - protein, 127 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARSSSSSWGGIGKWVWGMDYWGQGTLVTVSS

SEQ ID NO: 77 - protein, 127 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSSSSSSKWVWGMDYWGQGTLVTVSS

SEQ ID NO: 78 - protein, 127 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSWGGIGSSSSSMDYWGQGTLVTVSS

SEQ ID NO: 79 - protein, 126 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSSSSSKWVWGMDYWGQGTLVTVSS

SEQ ID NO: 80 - protein, 125 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSSSSKWVWGMDYWGQGTLVTVSS

SEQ ID NO: 81 - protein, 124 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSSSKWVWGMDYWGQGTLVTVSS

SEQ ID NO: 82 - protein, 123 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSSKWVWGMDYWGQGTLVTVSS

SEQ ID NO: 83 - protein, 122 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSKWVWGMDYWGQGTLVTVSS

SEQ ID NO: 84 - protein, 121 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYKWVWGMDYWGQGTLVTVSS

SEQ ID NO: 85 - protein, 124 aa, Artificial Sequence
  Synthetic Polypeptide
EVQLVESGGGLVQPGGSLRLSCAASGFTVSSSSIHWVRQAPGKGLEWVAYIYPYSSSSSYADSVKGRFTISADTSKNTAYLQMNSLRAEDTAVYYCARYSTYSSSKWVWGMDYWGQGTLVTVSS

SEQ ID NO: 86 - protein, 123 aa, Artificial Sequence
  Synthetic Polypeptide
EVQLVESGGGLVQPGGSLRLSCAASGFTVSSSSIHWVRQAPGKGLEWVAYIYPYSSSSSYADSVKGRFTISADTSKNTAYLQMNSLRAEDTAVYYCARYSTYSSKWVWGMDYWGQGTLVTVSS

SEQ ID NO: 87 - protein, 121 aa, Artificial Sequence
  Synthetic Polypeptide
EVQLVESGGGLVQPGGSLRLSCAASGFTVSSSSIHWVRQAPGKGLEWVAYIYPYSSSSSYADSVKGRFTISADTSKNTAYLQMNSLRAEDTAVYYCARYSTYKWVWGMDYWGQGTLVTVSS

SEQ ID NO: 88 - protein, 214 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQSWVGSLITFGQGTKVEIKTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 89 - protein, 215 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQWQWGYSLVTFGQGTKVEIKTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 90 - protein, 215 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQSWYSNKPITFGQGTKVEIKTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 91 - protein, 214 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQSSSSLITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 92 - protein, 216 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQYYGWFYPVTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 93 - protein, 214 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQYHSSLFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 94 - protein, 216 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQYPGYRGLITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 95 - protein, 216 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQSYYDSNPITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 96 - protein, 216 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQSYFHKIPITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 97 - protein, 215 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQWYWYYPVTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 98 - protein, 214 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQTYWGLITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 99 - protein, 215 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQYKSKYPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 100 - protein, 214 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQSSWGLITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 101 - protein, 215 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQFWGSKLFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 102 - protein, 216 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQMYYPGYLITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 103 - protein, 215 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQDRWWSALTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 104 - protein, 216 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQSYGSWYPITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 105 - protein, 215 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQGWYASPITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 106 - protein, 215 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQYSSHKYPFTFGQGTKVEIKTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 107 - protein, 216 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQWVYPGSLITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 108 - protein, 214 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQSSTDPITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 109 - protein, 215 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQSSQYDLITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 110 - protein, 215 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQSSSSSLFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 111 - protein, 216 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQRWYPGDLITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 112 - protein, 215 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQSYFPSLVTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 113 - protein, 214 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQWSQSPVTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 114 - protein, 215 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQSYVYYPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 115 - protein, 216 aa, Artificial Sequence
  Synthetic Polypeptide
DIQMTQSPSSLSASVGDRVTITCRASQSVSSAVAWYQQKPGKAPKLLIYSASSLYSGVPSRFSGSRSGTDFTLTISSLQPEDFATYYCQQGGWYYGPITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 116 - protein, 457 aa, Artificial Sequence
  Synthetic Polypeptide
EVQLVESGGGLVQPGGSLRLSCAASGFTFSSSSIHWVRQAPGKGLEWVASIYSSYGYTYYADSVKGRFTISADTSKNTAYLQMNSLRAEDTAVYYCARYYWGWSQNQGFWWYGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 117 - protein, 453 aa, Artificial Sequence
  Synthetic Polypeptide
EVQLVESGGGLVQPGGSLRLSCAASGFTISSSSIHWVRQAPGKGLEWVASISSYYGSTYYADSVKGRFTISADTSKNTAYLQMNSLRAEDTAVYYCARSWSSSFWYNWALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 118 - protein, 455 aa, Artificial Sequence
  Synthetic Polypeptide
EVQLVESGGGLVQPGGSLRLSCAASGFTIYSSSIHWVRQAPGKGLEWVAYIYSSSGYTSYADSVKGRFTISADTSKNTAYLQMNSLRAEDTAVYYCARYSHSSLYYSWIWALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 119 - protein, 453 aa, Artificial Sequence
  Synthetic Polypeptide
EVQLVESGGGLVQPGGSLRLSCAASGFTIYYSSIHWVRQAPGKGLEWVASISSSSGSTSYADSVKGRFTISADTSKNTAYLQMNSLRAEDTAVYYCARSYRPYSSYYWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 120 - protein, 458 aa, Artificial Sequence
  Synthetic Polypeptide
EVQLVESGGGLVQPGGSLRLSCAASGFTIYYSSIHWVRQAPGKGLEWVASISSSYGSTYYADSVKGRFTISADTSKNTAYLQMNSLRAEDTAVYYCARSVSWYPYYYYYGYGSGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 121 - protein, 458 aa, Artificial Sequence
  Synthetic Polypeptide
EVQLVESGGGLVQPGGSLRLSCAASGFTLSSSSIHWVRQAPGKGLEWVASIYSSYGSTSYADSVKGRFTISADTSKNTAYLQMNSLRAEDTAVYYCARSSHWYMYWSYWGWYIGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 122 - protein, 456 aa, Artificial Sequence
  Synthetic Polypeptide
EVQLVESGGGLVQPGGSLRLSCAASGFTVSSSSIHWVRQAPGKGLEWVASISSYYGYTYYADSVKGRFTISADTSKNTAYLQMNSLRAEDTAVYYCARSYSYGYDYFVKYYTMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 123 - protein, 457 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSWGGIGKWVWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 124 - protein, 457 aa, Artificial Sequence
  Synthetic Polypeptide
EVQLVESGGGLVQPGGSLRLSCAASGFTVSSSSIHWVRQAPGKGLEWVASSSSSSGYTSYADSVKGRFTISADTSKNTAYLQMNSLRAEDTAVYYCARYSTYSWGGIGKWVWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 125 - protein, 457 aa, Artificial Sequence
  Synthetic Polypeptide
EVQLVESGGGLVQPGGSLRLSCAASGFTVSSSSIHWVRQAPGKGLEWVAYIYPYSSSSSYADSVKGRFTISADTSKNTAYLQMNSLRAEDTAVYYCARYSTYSWGGIGKWVWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 126 - protein, 457 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARSSSSSWGGIGKWVWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 127 - protein, 457 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSSSSSSKWVWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 128 - protein, 457 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSWGGIGSSSSSMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 129 - protein, 456 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSSSSSKWVWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 130 - protein, 455 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSSSSKWVWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 131 - protein, 454 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSSSKWVWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 132 - protein, 453 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSSKWVWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 133 - protein, 452 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSKWVWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 134 - protein, 451 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYKWVWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 135 - protein, 454 aa, Artificial Sequence
  Synthetic Polypeptide
EVQLVESGGGLVQPGGSLRLSCAASGFTVSSSSIHWVRQAPGKGLEWVAYIYPYSSSSSYADSVKGRFTISADTSKNTAYLQMNSLRAEDTAVYYCARYSTYSSSKWVWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 136 - protein, 453 aa, Artificial Sequence
  Synthetic Polypeptide
EVQLVESGGGLVQPGGSLRLSCAASGFTVSSSSIHWVRQAPGKGLEWVAYIYPYSSSSSYADSVKGRFTISADTSKNTAYLQMNSLRAEDTAVYYCARYSTYSSKWVWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 137 - protein, 451 aa, Artificial Sequence
  Synthetic Polypeptide
EVQLVESGGGLVQPGGSLRLSCAASGFTVSSSSIHWVRQAPGKGLEWVAYIYPYSSSSSYADSVKGRFTISADTSKNTAYLQMNSLRAEDTAVYYCARYSTYKWVWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 138 - protein, 454 aa, Artificial Sequence
  Synthetic Polypeptide
EVQLVESGGGLVQPGGSLRLSCAASGFTVSSSSIHWVRQAPGKGLEWVAYIYSSSGYTSYADSVKGRFTISADTSKNTAYLQMNSLRAEDTAVYYCARYSSYHYPYWLFAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 139 - protein, 459 aa, Artificial Sequence
  Synthetic Polypeptide
EVQLVESGGGLVQPGGSLRLSCAASGFTVSYSSIHWVRQAPGKGLEWVASIYSYYGSTYYADSVKGRFTISADTSKNTAYLQMNSLRAEDTAVYYCARGHYQEGRKSGFSYWSPALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 140 - protein, 460 aa, Artificial Sequence
  Synthetic Polypeptide
EVQLVESGGGLVQPGGSLRLSCAASGFTVYSSSIHWVRQAPGKGLEWVASIYSYYGYTSYADSVKGRFTISADTSKNTAYLQMNSLRAEDTAVYYCARSTEGYDRWGYYSSYWSSGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 141 - protein, 457 aa, Artificial Sequence
  Synthetic Polypeptide
EVQLVESGGGLVQPGGSLRLSCAASGFTLYSSSIHWVRQAPGKGLEWVASIYSSSGYTYYADSVKGRFTISADTSKNTAYLQMNSLRAEDTAVYYCARTYTWKSSWSYQTGYGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 142 - protein, 459 aa, Artificial Sequence
  Synthetic Polypeptide
EVQLVESGGGLVQPGGSLRLSCAASGFTFSSSSIHWVRQAPGKGLEWVASISPYYGSTYYADSVKGRFTISADTSKNTAYLQMNSLRAEDTAVYYCARAVYYYVYNRSWYWWSGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 143 - protein, 456 aa, Artificial Sequence
  Synthetic Polypeptide
EVQLVESGGGLVQPGGSLRLSCAASGFTFSSSSIHWVRQAPGKGLEWVASISSSSGSTSYADSVKGRFTISADTSKNTAYLQMNSLRAEDTAVYYCARPAYSYPYYYFHYGAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 144 - protein, 455 aa, Artificial Sequence
  Synthetic Polypeptide
EVQLVESGGGLVQPGGSLRLSCAASGFTFSSSSIHWVRQAPGKGLEWVASIYPSYGYTSYADSVKGRFTISADTSKNTAYLQMNSLRAEDTAVYYCARAWYHHEYWGHYSGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 145 - protein, 455 aa, Artificial Sequence
  Synthetic Polypeptide
EVQLVESGGGLVQPGGSLRLSCAASGFTFSSSSIHWVRQAPGKGLEWVASIYSSYGSTYYADSVKGRFTISADTSKNTAYLQMNSLRAEDTAVYYCARSGYSHPYYSYYSGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 146 - protein, 457 aa, Artificial Sequence
  Synthetic Polypeptide
EVQLVESGGGLVQPGGSLRLSCAASGFTFSSSSIHWVRQAPGKGLEWVASIYSYSGYTYYADSVKGRFTISADTSKNTAYLQMNSLRAEDTAVYYCARTYMAGYKYYFISGYGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 147 - protein, 454 aa, Artificial Sequence
  Synthetic Polypeptide
EVQLVESGGGLVQPGGSLRLSCAASGFTFSYSSIHWVRQAPGKGLEWVASIYPSYGYTYYADSVKGRFTISADTSKNTAYLQMNSLRAEDTAVYYCARYWDYGWMYFDPAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 148 - protein, 454 aa, Artificial Sequence
  Synthetic Polypeptide
EVQLVESGGGLVQPGGSLRLSCAASGFTFSYSSIHWVRQAPGKGLEWVASIYSYSGYTSYADSVKGRFTISADTSKNTAYLQMNSLRAEDTAVYYCARYMENWEWPYHSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 149 - protein, 460 aa, Artificial Sequence
  Synthetic Polypeptide
EVQLVESGGGLVQPGGSLRLSCAASGFTFYSSSIHWVRQAPGKGLEWVASIYSSYGSTYYADSVKGRFTISADTSKNTAYLQMNSLRAEDTAVYYCARSWWYPYWQYYPGGWHSSGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 150 - protein, 454 aa, Artificial Sequence
  Synthetic Polypeptide
EVQLVESGGGLVQPGGSLRLSCAASGFTFYSSSIHWVRQAPGKGLEWVAYISPSSGYTSYADSVKGRFTISADTSKNTAYLQMNSLRAEDTAVYYCARYTMTYQYYPSGAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 151 - protein, 459 aa, Artificial Sequence
  Synthetic Polypeptide
EVQLVESGGGLVQPGGSLRLSCAASGFTIYSSYIHWVRQAPGKGLEWVASIYSSSGYTYYADSVKGRFTISADTSKNTAYLQMNSLRAEDTAVYYCARSYIYYMWQYNYGMSGYGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 152 - protein, 455 aa, Artificial Sequence
  Synthetic Polypeptide
EVQLVESGGGLVQPGGSLRLSCAASGFTLSYSSIHWVRQAPGKGLEWVASISSSYGYTYYADSVKGRFTISADTSKNTAYLQMNSLRAEDTAVYYCARHSPYYLHSWWWSGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 153 - protein, 453 aa, Artificial Sequence
  Synthetic Polypeptide
EVQLVESGGGLVQPGGSLRLSCAASGFTLYYSSIHWVRQAPGKGLEWVASISPSYGSTSYADSVKGRFTISADTSKNTAYLQMNSLRAEDTAVYYCARHSWYYPYYYYALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 154 - protein, 453 aa, Artificial Sequence
  Synthetic Polypeptide
EVQLVESGGGLVQPGGSLRLSCAASGFTVSSSSIHWVRQAPGKGLEWVASISSSSGYTYYADSVKGRFTISADTSKNTAYLQMNSLRAEDTAVYYCARYWSYPYVYFLAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 155 - protein, 459 aa, Artificial Sequence
  Synthetic Polypeptide
EVQLVESGGGLVQPGGSLRLSCAASGFTVSSSSIHWVRQAPGKGLEWVASIYSSSGYTSYADSVKGRFTISADTSKNTAYLQMNSLRAEDTAVYYCARNVENYPYWAWPWGYYGAIDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 156 - protein, 453 aa, Artificial Sequence
  Synthetic Polypeptide
EVQLVESGGGLVQPGGSLRLSCAASGFTVSSSSIHWVRQAPGKGLEWVASIYSSSGYTYYADSVKGRFTISADTSKNTAYLQMNSLRAEDTAVYYCARTYKWSYYTGYGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 157 - protein, 454 aa, Artificial Sequence
  Synthetic Polypeptide
EVQLVESGGGLVQPGGSLRLSCAASGFTVSSSSIHWVRQAPGKGLEWVAYISSSSGYTYYADSVKGRFTISADTSKNTAYLQMNSLRAEDTAVYYCARYWSYPSWWPYRGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 158 - protein, 454 aa, Artificial Sequence
  Synthetic Polypeptide
EVQLVESGGGLVQPGGSLRLSCAASGFTVSSSSIHWVRQAPGKGLEWVAYISSSSGYTYYADSVKGRFTISADTSKNTAYLQMNSLRAEDTAVYYCARYWSYPSWSPYRGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 159 - protein, 455 aa, Artificial Sequence
  Synthetic Polypeptide
EVQLVESGGGLVQPGGSLRLSCAASGFTVSSYSIHWVRQAPGKGLEWVAYIYSSSGYTSYADSVKGRFTISADTSKNTAYLQMNSLRAEDTAVYYCARVGYYYPYLYLGDGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 160 - protein, 460 aa, Artificial Sequence
  Synthetic Polypeptide
EVQLVESGGGLVQPGGSLRLSCAASGFTVSSYSIHWVRQAPGKGLEWVASISSSSGSTSYADSVKGRFTISADTSKNTAYLQMNSLRAEDTAVYYCARNAWHYEPSYWYGNYATYGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 161 - protein, 453 aa, Artificial Sequence
  Synthetic Polypeptide
EVQLVESGGGLVQPGGSLRLSCAASGFTVSYSSIHWVRQAPGKGLEWVASISSSSSSTYYADSVKGRFTISADTSKNTAYLQMNSLRAEDTAVYYCARGQQYYPDQYWGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 162 - protein, 458 aa, Artificial Sequence
  Synthetic Polypeptide
EVQLVESGGGLVQPGGSLRLSCAASGFTVSYSSIHWVRQAPGKGLEWVASIYSSSGYTYYADSVKGRFTISADTSKNTAYLQMNSLRAEDTAVYYCARTYYTYFDWWRTAVYYGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 163 - protein, 456 aa, Artificial Sequence
  Synthetic Polypeptide
EVQLVESGGGLVQPGGSLRLSCAASGFTVYSSSIHWVRQAPGKGLEWVASISSSYGYTSYADSVKGRFTISADTSKNTAYLQMNSLRAEDTAVYYCARDYYNYMSSYWWYSALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 164 - protein, 458 aa, Artificial Sequence
  Synthetic Polypeptide
EVQLVESGGGLVQPGGSLRLSCAASGFTVYSSSIHWVRQAPGKGLEWVASIYPYYGYTSYADSVKGRFTISADTSKNTAYLQMNSLRAEDTAVYYCARKIFWPVSWMWQGYYPALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 165 - protein, 453 aa, Artificial Sequence
  Synthetic Polypeptide
EVQLVESGGGLVQPGGSLRLSCAASGFTVYSSSIHWVRQAPGKGLEWVASIYSSYGYTSYADSVKGRFTISADTSKNTAYLQMNSLRAEDTAVYYCARSYSSETHYGWAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 166 - protein, 457 aa, Artificial Sequence
  Synthetic Polypeptide
EVQLVESGGGLVQPGGSLRLSCAASGFTLSSSSIHWVRQAPGKGLEWVASIYSSYGSTSYADSVKGRFTISADTSKNTAYLQMNSLRAEDTAVYYCARQYYTYFEWYMGWGYALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 167 - protein, 455 aa, Artificial Sequence
  Synthetic Polypeptide
EVQLVESGGGLVQPGGSLRLSCAASGFTVSSSSIHWVRQAPGKGLEWVAYISSYSGSTYYADSVKGRFTISADTSKNTAYLQMNSLRAEDTAVYYCARSSALYWMDFSYSALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 168 - protein, 454 aa, Artificial Sequence
  Synthetic Polypeptide
EVQLVESGGGLVQPGGSLRLSCAASGFTVSSSSIHWVRQAPGKGLEWVAYISSSSGYTYYADSVKGRFTISADTSKNTAYLQMNSLRAEDTAVYYCARSSSSSSSSSSSSSDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 169 - protein, 457 aa, Artificial Sequence
  Synthetic Polypeptide
EVQLVESGGGLVQPGGSLRLSCAASGFTFSSSSIHWVRQAPGKGLEWVASIYSSYGYTYYADSVKGRFTISADTSKNTAYLQMNSLRAEDTAVYYCARYYWGWSQNQGFWWYGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 170 - protein, 453 aa, Artificial Sequence
  Synthetic Polypeptide
EVQLVESGGGLVQPGGSLRLSCAASGFTISSSSIHWVRQAPGKGLEWVASISSYYGSTYYADSVKGRFTISADTSKNTAYLQMNSLRAEDTAVYYCARSWSSSFWYNWALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 171 - protein, 455 aa, Artificial Sequence
  Synthetic Polypeptide
EVQLVESGGGLVQPGGSLRLSCAASGFTIYSSSIHWVRQAPGKGLEWVAYIYSSSGYTSYADSVKGRFTISADTSKNTAYLQMNSLRAEDTAVYYCARYSHSSLYYSWIWALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 172 - protein, 453 aa, Artificial Sequence
  Synthetic Polypeptide
EVQLVESGGGLVQPGGSLRLSCAASGFTIYYSSIHWVRQAPGKGLEWVASISSSSGSTSYADSVKGRFTISADTSKNTAYLQMNSLRAEDTAVYYCARSYRPYSSYYWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 173 - protein, 458 aa, Artificial Sequence
  Synthetic Polypeptide
EVQLVESGGGLVQPGGSLRLSCAASGFTIYYSSIHWVRQAPGKGLEWVASISSSYGSTYYADSVKGRFTISADTSKNTAYLQMNSLRAEDTAVYYCARSVSWYPYYYYYGYGSGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 174 - protein, 458 aa, Artificial Sequence
  Synthetic Polypeptide
EVQLVESGGGLVQPGGSLRLSCAASGFTLSSSSIHWVRQAPGKGLEWVASIYSSYGSTSYADSVKGRFTISADTSKNTAYLQMNSLRAEDTAVYYCARSSHWYMYWSYWGWYIGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 175 - protein, 456 aa, Artificial Sequence
  Synthetic Polypeptide
EVQLVESGGGLVQPGGSLRLSCAASGFTVSSSSIHWVRQAPGKGLEWVASISSYYGYTYYADSVKGRFTISADTSKNTAYLQMNSLRAEDTAVYYCARSYSYGYDYFVKYYTMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 176 - protein, 457 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSWGGIGKWVWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 177 - protein, 457 aa, Artificial Sequence
  Synthetic Polypeptide
EVQLVESGGGLVQPGGSLRLSCAASGFTVSSSSIHWVRQAPGKGLEWVASSSSSSGYTSYADSVKGRFTISADTSKNTAYLQMNSLRAEDTAVYYCARYSTYSWGGIGKWVWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 178 - protein, 457 aa, Artificial Sequence
  Synthetic Polypeptide
EVQLVESGGGLVQPGGSLRLSCAASGFTVSSSSIHWVRQAPGKGLEWVAYIYPYSSSSSYADSVKGRFTISADTSKNTAYLQMNSLRAEDTAVYYCARYSTYSWGGIGKWVWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 179 - protein, 457 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARSSSSSWGGIGKWVWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 180 - protein, 457 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSSSSSSKWVWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 181 - protein, 457 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSWGGIGSSSSSMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 182 - protein, 456 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSSSSSKWVWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 183 - protein, 455 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSSSSKWVWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 184 - protein, 454 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSSSKWVWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 185 - protein, 453 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSSKWVWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 186 - protein, 452 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSKWVWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 187 - protein, 451 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYKWVWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 188 - protein, 454 aa, Artificial Sequence
  Synthetic Polypeptide
EVQLVESGGGLVQPGGSLRLSCAASGFTVSSSSIHWVRQAPGKGLEWVAYIYPYSSSSSYADSVKGRFTISADTSKNTAYLQMNSLRAEDTAVYYCARYSTYSSSKWVWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 189 - protein, 453 aa, Artificial Sequence
  Synthetic Polypeptide
EVQLVESGGGLVQPGGSLRLSCAASGFTVSSSSIHWVRQAPGKGLEWVAYIYPYSSSSSYADSVKGRFTISADTSKNTAYLQMNSLRAEDTAVYYCARYSTYSSKWVWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 190 - protein, 451 aa, Artificial Sequence
  Synthetic Polypeptide
EVQLVESGGGLVQPGGSLRLSCAASGFTVSSSSIHWVRQAPGKGLEWVAYIYPYSSSSSYADSVKGRFTISADTSKNTAYLQMNSLRAEDTAVYYCARYSTYKWVWGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 191 - protein, 454 aa, Artificial Sequence
  Synthetic Polypeptide
EVQLVESGGGLVQPGGSLRLSCAASGFTVSSSSIHWVRQAPGKGLEWVAYIYSSSGYTSYADSVKGRFTISADTSKNTAYLQMNSLRAEDTAVYYCARYSSYHYPYWLFAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 192 - protein, 459 aa, Artificial Sequence
  Synthetic Polypeptide
EVQLVESGGGLVQPGGSLRLSCAASGFTVSYSSIHWVRQAPGKGLEWVASIYSYYGSTYYADSVKGRFTISADTSKNTAYLQMNSLRAEDTAVYYCARGHYQEGRKSGFSYWSPALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 193 - protein, 460 aa, Artificial Sequence
  Synthetic Polypeptide
EVQLVESGGGLVQPGGSLRLSCAASGFTVYSSSIHWVRQAPGKGLEWVASIYSYYGYTSYADSVKGRFTISADTSKNTAYLQMNSLRAEDTAVYYCARSTEGYDRWGYYSSYWSSGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 194 - protein, 457 aa, Artificial Sequence
  Synthetic Polypeptide
EVQLVESGGGLVQPGGSLRLSCAASGFTLYSSSIHWVRQAPGKGLEWVASIYSSSGYTYYADSVKGRFTISADTSKNTAYLQMNSLRAEDTAVYYCARTYTWKSSWSYQTGYGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 195 - protein, 459 aa, Artificial Sequence
  Synthetic Polypeptide
EVQLVESGGGLVQPGGSLRLSCAASGFTFSSSSIHWVRQAPGKGLEWVASISPYYGSTYYADSVKGRFTISADTSKNTAYLQMNSLRAEDTAVYYCARAVYYYVYNRSWYWWSGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 196 - protein, 456 aa, Artificial Sequence
  Synthetic Polypeptide
EVQLVESGGGLVQPGGSLRLSCAASGFTFSSSSIHWVRQAPGKGLEWVASISSSSGSTSYADSVKGRFTISADTSKNTAYLQMNSLRAEDTAVYYCARPAYSYPYYYFHYGAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 197 - protein, 455 aa, Artificial Sequence
  Synthetic Polypeptide
EVQLVESGGGLVQPGGSLRLSCAASGFTFSSSSIHWVRQAPGKGLEWVASIYPSYGYTSYADSVKGRFTISADTSKNTAYLQMNSLRAEDTAVYYCARAWYHHEYWGHYSGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 198 - protein, 455 aa, Artificial Sequence
  Synthetic Polypeptide
EVQLVESGGGLVQPGGSLRLSCAASGFTFSSSSIHWVRQAPGKGLEWVASIYSSYGSTYYADSVKGRFTISADTSKNTAYLQMNSLRAEDTAVYYCARSGYSHPYYSYYSGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 199 - protein, 457 aa, Artificial Sequence
  Synthetic Polypeptide
EVQLVESGGGLVQPGGSLRLSCAASGFTFSSSSIHWVRQAPGKGLEWVASIYSYSGYTYYADSVKGRFTISADTSKNTAYLQMNSLRAEDTAVYYCARTYMAGYKYYFISGYGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 200 - protein, 454 aa, Artificial Sequence
  Synthetic Polypeptide
EVQLVESGGGLVQPGGSLRLSCAASGFTFSYSSIHWVRQAPGKGLEWVASIYPSYGYTYYADSVKGRFTISADTSKNTAYLQMNSLRAEDTAVYYCARYWDYGWMYFDPAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 201 - protein, 454 aa, Artificial Sequence
  Synthetic Polypeptide
EVQLVESGGGLVQPGGSLRLSCAASGFTFSYSSIHWVRQAPGKGLEWVASIYSYSGYTSYADSVKGRFTISADTSKNTAYLQMNSLRAEDTAVYYCARYMENWEWPYHSAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 202 - protein, 460 aa, Artificial Sequence
  Synthetic Polypeptide
EVQLVESGGGLVQPGGSLRLSCAASGFTFYSSSIHWVRQAPGKGLEWVASIYSSYGSTYYADSVKGRFTISADTSKNTAYLQMNSLRAEDTAVYYCARSWWYPYWQYYPGGWHSSGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 203 - protein, 454 aa, Artificial Sequence
  Synthetic Polypeptide
EVQLVESGGGLVQPGGSLRLSCAASGFTFYSSSIHWVRQAPGKGLEWVAYISPSSGYTSYADSVKGRFTISADTSKNTAYLQMNSLRAEDTAVYYCARYTMTYQYYPSGAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 204 - protein, 459 aa, Artificial Sequence
  Synthetic Polypeptide
EVQLVESGGGLVQPGGSLRLSCAASGFTIYSSYIHWVRQAPGKGLEWVASIYSSSGYTYYADSVKGRFTISADTSKNTAYLQMNSLRAEDTAVYYCARSYIYYMWQYNYGMSGYGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205 - protein, 455 aa, Artificial Sequence
  Synthetic Polypeptide
EVQLVESGGGLVQPGGSLRLSCAASGFTLSYSSIHWVRQAPGKGLEWVASISSSYGYTYYADSVKGRFTISADTSKNTAYLQMNSLRAEDTAVYYCARHSPYYLHSWWWSGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 206 - protein, 453 aa, Artificial Sequence
  Synthetic Polypeptide
EVQLVESGGGLVQPGGSLRLSCAASGFTLYYSSIHWVRQAPGKGLEWVASISPSYGSTSYADSVKGRFTISADTSKNTAYLQMNSLRAEDTAVYYCARHSWYYPYYYYALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 207 - protein, 453 aa, Artificial Sequence
  Synthetic Polypeptide
EVQLVESGGGLVQPGGSLRLSCAASGFTVSSSSIHWVRQAPGKGLEWVASISSSSGYTYYADSVKGRFTISADTSKNTAYLQMNSLRAEDTAVYYCARYWSYPYVYFLAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 208 - protein, 459 aa, Artificial Sequence
  Synthetic Polypeptide
EVQLVESGGGLVQPGGSLRLSCAASGFTVSSSSIHWVRQAPGKGLEWVASIYSSSGYTSYADSVKGRFTISADTSKNTAYLQMNSLRAEDTAVYYCARNVENYPYWAWPWGYYGAIDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 209 - protein, 453 aa, Artificial Sequence
  Synthetic Polypeptide
EVQLVESGGGLVQPGGSLRLSCAASGFTVSSSSIHWVRQAPGKGLEWVASIYSSSGYTYYADSVKGRFTISADTSKNTAYLQMNSLRAEDTAVYYCARTYKWSYYTGYGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 210 - protein, 454 aa, Artificial Sequence
  Synthetic Polypeptide
EVQLVESGGGLVQPGGSLRLSCAASGFTVSSSSIHWVRQAPGKGLEWVAYISSSSGYTYYADSVKGRFTISADTSKNTAYLQMNSLRAEDTAVYYCARYWSYPSWWPYRGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 211 - protein, 454 aa, Artificial Sequence
  Synthetic Polypeptide
EVQLVESGGGLVQPGGSLRLSCAASGFTVSSSSIHWVRQAPGKGLEWVAYISSSSGYTYYADSVKGRFTISADTSKNTAYLQMNSLRAEDTAVYYCARYWSYPSWSPYRGMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 212 - protein, 455 aa, Artificial Sequence
  Synthetic Polypeptide
EVQLVESGGGLVQPGGSLRLSCAASGFTVSSYSIHWVRQAPGKGLEWVAYIYSSSGYTSYADSVKGRFTISADTSKNTAYLQMNSLRAEDTAVYYCARVGYYYPYLYLGDGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 213 - protein, 460 aa, Artificial Sequence
  Synthetic Polypeptide
EVQLVESGGGLVQPGGSLRLSCAASGFTVSSYSIHWVRQAPGKGLEWVASISSSSGSTSYADSVKGRFTISADTSKNTAYLQMNSLRAEDTAVYYCARNAWHYEPSYWYGNYATYGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 214 - protein, 453 aa, Artificial Sequence
  Synthetic Polypeptide
EVQLVESGGGLVQPGGSLRLSCAASGFTVSYSSIHWVRQAPGKGLEWVASISSSSSSTYYADSVKGRFTISADTSKNTAYLQMNSLRAEDTAVYYCARGQQYYPDQYWGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 215 - protein, 458 aa, Artificial Sequence
  Synthetic Polypeptide
EVQLVESGGGLVQPGGSLRLSCAASGFTVSYSSIHWVRQAPGKGLEWVASIYSSSGYTYYADSVKGRFTISADTSKNTAYLQMNSLRAEDTAVYYCARTYYTYFDWWRTAVYYGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 216 - protein, 456 aa, Artificial Sequence
  Synthetic Polypeptide
EVQLVESGGGLVQPGGSLRLSCAASGFTVYSSSIHWVRQAPGKGLEWVASISSSYGYTSYADSVKGRFTISADTSKNTAYLQMNSLRAEDTAVYYCARDYYNYMSSYWWYSALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 217 - protein, 458 aa, Artificial Sequence
  Synthetic Polypeptide
EVQLVESGGGLVQPGGSLRLSCAASGFTVYSSSIHWVRQAPGKGLEWVASIYPYYGYTSYADSVKGRFTISADTSKNTAYLQMNSLRAEDTAVYYCARKIFWPVSWMWQGYYPALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 218 - protein, 453 aa, Artificial Sequence
  Synthetic Polypeptide
EVQLVESGGGLVQPGGSLRLSCAASGFTVYSSSIHWVRQAPGKGLEWVASIYSSYGYTSYADSVKGRFTISADTSKNTAYLQMNSLRAEDTAVYYCARSYSSETHYGWAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 219 - protein, 457 aa, Artificial Sequence
  Synthetic Polypeptide
EVQLVESGGGLVQPGGSLRLSCAASGFTLSSSSIHWVRQAPGKGLEWVASIYSSYGSTSYADSVKGRFTISADTSKNTAYLQMNSLRAEDTAVYYCARQYYTYFEWYMGWGYALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 220 - protein, 455 aa, Artificial Sequence
  Synthetic Polypeptide
EVQLVESGGGLVQPGGSLRLSCAASGFTVSSSSIHWVRQAPGKGLEWVAYISSYSGSTYYADSVKGRFTISADTSKNTAYLQMNSLRAEDTAVYYCARSSALYWMDFSYSALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 221 - protein, 454 aa, Artificial Sequence
  Synthetic Polypeptide
EVQLVESGGGLVQPGGSLRLSCAASGFTVSSSSIHWVRQAPGKGLEWVAYISSSSGYTYYADSVKGRFTISADTSKNTAYLQMNSLRAEDTAVYYCARSSSSSSSSSSSSSDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 222 - protein, 454 aa, Artificial Sequence
  Synthetic Polypeptide
EVQLVESGGGLVQPGGSLRLSCAASGFTFSSSSIHWVRQAPGKGLEWVASIYSSYGYTYYADSVKGRFTISADTSKNTAYLQMNSLRAEDTAVYYCARYYWGWSQNQGFWWYGLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 223 - protein, 450 aa, Artificial Sequence
  Synthetic Polypeptide
EVQLVESGGGLVQPGGSLRLSCAASGFTISSSSIHWVRQAPGKGLEWVASISSYYGSTYYADSVKGRFTISADTSKNTAYLQMNSLRAEDTAVYYCARSWSSSFWYNWALDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 224 - protein, 452 aa, Artificial Sequence
  Synthetic Polypeptide
EVQLVESGGGLVQPGGSLRLSCAASGFTIYSSSIHWVRQAPGKGLEWVAYIYSSSGYTSYADSVKGRFTISADTSKNTAYLQMNSLRAEDTAVYYCARYSHSSLYYSWIWALDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 225 - protein, 450 aa, Artificial Sequence
  Synthetic Polypeptide
EVQLVESGGGLVQPGGSLRLSCAASGFTIYYSSIHWVRQAPGKGLEWVASISSSSGSTSYADSVKGRFTISADTSKNTAYLQMNSLRAEDTAVYYCARSYRPYSSYYWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 226 - protein, 455 aa, Artificial Sequence
  Synthetic Polypeptide
EVQLVESGGGLVQPGGSLRLSCAASGFTIYYSSIHWVRQAPGKGLEWVASISSSYGSTYYADSVKGRFTISADTSKNTAYLQMNSLRAEDTAVYYCARSVSWYPYYYYYGYGSGLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 227 - protein, 455 aa, Artificial Sequence
  Synthetic Polypeptide
EVQLVESGGGLVQPGGSLRLSCAASGFTLSSSSIHWVRQAPGKGLEWVASIYSSYGSTSYADSVKGRFTISADTSKNTAYLQMNSLRAEDTAVYYCARSSHWYMYWSYWGWYIGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 228 - protein, 453 aa, Artificial Sequence
  Synthetic Polypeptide
EVQLVESGGGLVQPGGSLRLSCAASGFTVSSSSIHWVRQAPGKGLEWVASISSYYGYTYYADSVKGRFTISADTSKNTAYLQMNSLRAEDTAVYYCARSYSYGYDYFVKYYTMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 229 - protein, 454 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSWGGIGKWVWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 230 - protein, 454 aa, Artificial Sequence
  Synthetic Polypeptide
EVQLVESGGGLVQPGGSLRLSCAASGFTVSSSSIHWVRQAPGKGLEWVASSSSSSGYTSYADSVKGRFTISADTSKNTAYLQMNSLRAEDTAVYYCARYSTYSWGGIGKWVWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 231 - protein, 454 aa, Artificial Sequence
  Synthetic Polypeptide
EVQLVESGGGLVQPGGSLRLSCAASGFTVSSSSIHWVRQAPGKGLEWVAYIYPYSSSSSYADSVKGRFTISADTSKNTAYLQMNSLRAEDTAVYYCARYSTYSWGGIGKWVWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 232 - protein, 454 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARSSSSSWGGIGKWVWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 233 - protein, 454 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSSSSSSKWVWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 234 - protein, 454 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSWGGIGSSSSSMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 235 - protein, 453 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSSSSSKWVWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 236 - protein, 452 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSSSSKWVWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 237 - protein, 451 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSSSKWVWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 238 - protein, 450 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSSKWVWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 239 - protein, 449 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSKWVWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 240 - protein, 448 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYKWVWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 241 - protein, 451 aa, Artificial Sequence
  Synthetic Polypeptide
EVQLVESGGGLVQPGGSLRLSCAASGFTVSSSSIHWVRQAPGKGLEWVAYIYPYSSSSSYADSVKGRFTISADTSKNTAYLQMNSLRAEDTAVYYCARYSTYSSSKWVWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 242 - protein, 450 aa, Artificial Sequence
  Synthetic Polypeptide
EVQLVESGGGLVQPGGSLRLSCAASGFTVSSSSIHWVRQAPGKGLEWVAYIYPYSSSSSYADSVKGRFTISADTSKNTAYLQMNSLRAEDTAVYYCARYSTYSSKWVWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 243 - protein, 448 aa, Artificial Sequence
  Synthetic Polypeptide
EVQLVESGGGLVQPGGSLRLSCAASGFTVSSSSIHWVRQAPGKGLEWVAYIYPYSSSSSYADSVKGRFTISADTSKNTAYLQMNSLRAEDTAVYYCARYSTYKWVWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 244 - protein, 451 aa, Artificial Sequence
  Synthetic Polypeptide
EVQLVESGGGLVQPGGSLRLSCAASGFTVSSSSIHWVRQAPGKGLEWVAYIYSSSGYTSYADSVKGRFTISADTSKNTAYLQMNSLRAEDTAVYYCARYSSYHYPYWLFAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 245 - protein, 456 aa, Artificial Sequence
  Synthetic Polypeptide
EVQLVESGGGLVQPGGSLRLSCAASGFTVSYSSIHWVRQAPGKGLEWVASIYSYYGSTYYADSVKGRFTISADTSKNTAYLQMNSLRAEDTAVYYCARGHYQEGRKSGFSYWSPALDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 246 - protein, 457 aa, Artificial Sequence
  Synthetic Polypeptide
EVQLVESGGGLVQPGGSLRLSCAASGFTVYSSSIHWVRQAPGKGLEWVASIYSYYGYTSYADSVKGRFTISADTSKNTAYLQMNSLRAEDTAVYYCARSTEGYDRWGYYSSYWSSGLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 247 - protein, 454 aa, Artificial Sequence
  Synthetic Polypeptide
EVQLVESGGGLVQPGGSLRLSCAASGFTLYSSSIHWVRQAPGKGLEWVASIYSSSGYTYYADSVKGRFTISADTSKNTAYLQMNSLRAEDTAVYYCARTYTWKSSWSYQTGYGLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 248 - protein, 456 aa, Artificial Sequence
  Synthetic Polypeptide
EVQLVESGGGLVQPGGSLRLSCAASGFTFSSSSIHWVRQAPGKGLEWVASISPYYGSTYYADSVKGRFTISADTSKNTAYLQMNSLRAEDTAVYYCARAVYYYVYNRSWYWWSGGFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 249 - protein, 453 aa, Artificial Sequence
  Synthetic Polypeptide
EVQLVESGGGLVQPGGSLRLSCAASGFTFSSSSIHWVRQAPGKGLEWVASISSSSGSTSYADSVKGRFTISADTSKNTAYLQMNSLRAEDTAVYYCARPAYSYPYYYFHYGAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 250 - protein, 452 aa, Artificial Sequence
  Synthetic Polypeptide
EVQLVESGGGLVQPGGSLRLSCAASGFTFSSSSIHWVRQAPGKGLEWVASIYPSYGYTSYADSVKGRFTISADTSKNTAYLQMNSLRAEDTAVYYCARAWYHHEYWGHYSGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 251 - protein, 452 aa, Artificial Sequence
  Synthetic Polypeptide
EVQLVESGGGLVQPGGSLRLSCAASGFTFSSSSIHWVRQAPGKGLEWVASIYSSYGSTYYADSVKGRFTISADTSKNTAYLQMNSLRAEDTAVYYCARSGYSHPYYSYYSGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 252 - protein, 454 aa, Artificial Sequence
  Synthetic Polypeptide
EVQLVESGGGLVQPGGSLRLSCAASGFTFSSSSIHWVRQAPGKGLEWVASIYSYSGYTYYADSVKGRFTISADTSKNTAYLQMNSLRAEDTAVYYCARTYMAGYKYYFISGYGFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 253 - protein, 451 aa, Artificial Sequence
  Synthetic Polypeptide
EVQLVESGGGLVQPGGSLRLSCAASGFTFSYSSIHWVRQAPGKGLEWVASIYPSYGYTYYADSVKGRFTISADTSKNTAYLQMNSLRAEDTAVYYCARYWDYGWMYFDPAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 254 - protein, 451 aa, Artificial Sequence
  Synthetic Polypeptide
EVQLVESGGGLVQPGGSLRLSCAASGFTFSYSSIHWVRQAPGKGLEWVASIYSYSGYTSYADSVKGRFTISADTSKNTAYLQMNSLRAEDTAVYYCARYMENWEWPYHSAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 255 - protein, 457 aa, Artificial Sequence
  Synthetic Polypeptide
EVQLVESGGGLVQPGGSLRLSCAASGFTFYSSSIHWVRQAPGKGLEWVASIYSSYGSTYYADSVKGRFTISADTSKNTAYLQMNSLRAEDTAVYYCARSWWYPYWQYYPGGWHSSGFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 256 - protein, 451 aa, Artificial Sequence
  Synthetic Polypeptide
EVQLVESGGGLVQPGGSLRLSCAASGFTFYSSSIHWVRQAPGKGLEWVAYISPSSGYTSYADSVKGRFTISADTSKNTAYLQMNSLRAEDTAVYYCARYTMTYQYYPSGAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 257 - protein, 456 aa, Artificial Sequence
  Synthetic Polypeptide
EVQLVESGGGLVQPGGSLRLSCAASGFTIYSSYIHWVRQAPGKGLEWVASIYSSSGYTYYADSVKGRFTISADTSKNTAYLQMNSLRAEDTAVYYCARSYIYYMWQYNYGMSGYGLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 258 - protein, 452 aa, Artificial Sequence
  Synthetic Polypeptide
EVQLVESGGGLVQPGGSLRLSCAASGFTLSYSSIHWVRQAPGKGLEWVASISSSYGYTYYADSVKGRFTISADTSKNTAYLQMNSLRAEDTAVYYCARHSPYYLHSWWWSGLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 259 - protein, 450 aa, Artificial Sequence
  Synthetic Polypeptide
EVQLVESGGGLVQPGGSLRLSCAASGFTLYYSSIHWVRQAPGKGLEWVASISPSYGSTSYADSVKGRFTISADTSKNTAYLQMNSLRAEDTAVYYCARHSWYYPYYYYALDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 260 - protein, 450 aa, Artificial Sequence
  Synthetic Polypeptide
EVQLVESGGGLVQPGGSLRLSCAASGFTVSSSSIHWVRQAPGKGLEWVASISSSSGYTYYADSVKGRFTISADTSKNTAYLQMNSLRAEDTAVYYCARYWSYPYVYFLAFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 261 - protein, 456 aa, Artificial Sequence
  Synthetic Polypeptide
EVQLVESGGGLVQPGGSLRLSCAASGFTVSSSSIHWVRQAPGKGLEWVASIYSSSGYTSYADSVKGRFTISADTSKNTAYLQMNSLRAEDTAVYYCARNVENYPYWAWPWGYYGAIDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 262 - protein, 450 aa, Artificial Sequence
  Synthetic Polypeptide
EVQLVESGGGLVQPGGSLRLSCAASGFTVSSSSIHWVRQAPGKGLEWVASIYSSSGYTYYADSVKGRFTISADTSKNTAYLQMNSLRAEDTAVYYCARTYKWSYYTGYGFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 263 - protein, 451 aa, Artificial Sequence
  Synthetic Polypeptide
EVQLVESGGGLVQPGGSLRLSCAASGFTVSSSSIHWVRQAPGKGLEWVAYISSSSGYTYYADSVKGRFTISADTSKNTAYLQMNSLRAEDTAVYYCARYWSYPSWWPYRGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 264 - protein, 451 aa, Artificial Sequence
  Synthetic Polypeptide
EVQLVESGGGLVQPGGSLRLSCAASGFTVSSSSIHWVRQAPGKGLEWVAYISSSSGYTYYADSVKGRFTISADTSKNTAYLQMNSLRAEDTAVYYCARYWSYPSWSPYRGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 265 - protein, 452 aa, Artificial Sequence
  Synthetic Polypeptide
EVQLVESGGGLVQPGGSLRLSCAASGFTVSSYSIHWVRQAPGKGLEWVAYIYSSSGYTSYADSVKGRFTISADTSKNTAYLQMNSLRAEDTAVYYCARVGYYYPYLYLGDGLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 266 - protein, 457 aa, Artificial Sequence
  Synthetic Polypeptide
EVQLVESGGGLVQPGGSLRLSCAASGFTVSSYSIHWVRQAPGKGLEWVASISSSSGSTSYADSVKGRFTISADTSKNTAYLQMNSLRAEDTAVYYCARNAWHYEPSYWYGNYATYGFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 267 - protein, 450 aa, Artificial Sequence
  Synthetic Polypeptide
EVQLVESGGGLVQPGGSLRLSCAASGFTVSYSSIHWVRQAPGKGLEWVASISSSSSSTYYADSVKGRFTISADTSKNTAYLQMNSLRAEDTAVYYCARGQQYYPDQYWGLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 268 - protein, 455 aa, Artificial Sequence
  Synthetic Polypeptide
EVQLVESGGGLVQPGGSLRLSCAASGFTVSYSSIHWVRQAPGKGLEWVASIYSSSGYTYYADSVKGRFTISADTSKNTAYLQMNSLRAEDTAVYYCARTYYTYFDWWRTAVYYGFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 269 - protein, 453 aa, Artificial Sequence
  Synthetic Polypeptide
EVQLVESGGGLVQPGGSLRLSCAASGFTVYSSSIHWVRQAPGKGLEWVASISSSYGYTSYADSVKGRFTISADTSKNTAYLQMNSLRAEDTAVYYCARDYYNYMSSYWWYSALDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 270 - protein, 455 aa, Artificial Sequence
  Synthetic Polypeptide
EVQLVESGGGLVQPGGSLRLSCAASGFTVYSSSIHWVRQAPGKGLEWVASIYPYYGYTSYADSVKGRFTISADTSKNTAYLQMNSLRAEDTAVYYCARKIFWPVSWMWQGYYPALDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 271 - protein, 450 aa, Artificial Sequence
  Synthetic Polypeptide
EVQLVESGGGLVQPGGSLRLSCAASGFTVYSSSIHWVRQAPGKGLEWVASIYSSYGYTSYADSVKGRFTISADTSKNTAYLQMNSLRAEDTAVYYCARSYSSETHYGWAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 272 - protein, 454 aa, Artificial Sequence
  Synthetic Polypeptide
EVQLVESGGGLVQPGGSLRLSCAASGFTLSSSSIHWVRQAPGKGLEWVASIYSSYGSTSYADSVKGRFTISADTSKNTAYLQMNSLRAEDTAVYYCARQYYTYFEWYMGWGYALDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 273 - protein, 452 aa, Artificial Sequence
  Synthetic Polypeptide
EVQLVESGGGLVQPGGSLRLSCAASGFTVSSSSIHWVRQAPGKGLEWVAYISSYSGSTYYADSVKGRFTISADTSKNTAYLQMNSLRAEDTAVYYCARSSALYWMDFSYSALDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 274 - protein, 451 aa, Artificial Sequence
  Synthetic Polypeptide
EVQLVESGGGLVQPGGSLRLSCAASGFTVSSSSIHWVRQAPGKGLEWVAYISSSSGYTYYADSVKGRFTISADTSKNTAYLQMNSLRAEDTAVYYCARSSSSSSSSSSSSSDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 275 - protein, 454 aa, Artificial Sequence
  Synthetic Polypeptide
EVQLVESGGGLVQPGGSLRLSCAASGFTFSSSSIHWVRQAPGKGLEWVASIYSSYGYTYYADSVKGRFTISADTSKNTAYLQMNSLRAEDTAVYYCARYYWGWSQNQGFWWYGLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 276 - protein, 450 aa, Artificial Sequence
  Synthetic Polypeptide
EVQLVESGGGLVQPGGSLRLSCAASGFTISSSSIHWVRQAPGKGLEWVASISSYYGSTYYADSVKGRFTISADTSKNTAYLQMNSLRAEDTAVYYCARSWSSSFWYNWALDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 277 - protein, 452 aa, Artificial Sequence
  Synthetic Polypeptide
EVQLVESGGGLVQPGGSLRLSCAASGFTIYSSSIHWVRQAPGKGLEWVAYIYSSSGYTSYADSVKGRFTISADTSKNTAYLQMNSLRAEDTAVYYCARYSHSSLYYSWIWALDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 278 - protein, 450 aa, Artificial Sequence
  Synthetic Polypeptide
EVQLVESGGGLVQPGGSLRLSCAASGFTIYYSSIHWVRQAPGKGLEWVASISSSSGSTSYADSVKGRFTISADTSKNTAYLQMNSLRAEDTAVYYCARSYRPYSSYYWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 279 - protein, 455 aa, Artificial Sequence
  Synthetic Polypeptide
EVQLVESGGGLVQPGGSLRLSCAASGFTIYYSSIHWVRQAPGKGLEWVASISSSYGSTYYADSVKGRFTISADTSKNTAYLQMNSLRAEDTAVYYCARSVSWYPYYYYYGYGSGLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 280 - protein, 455 aa, Artificial Sequence
  Synthetic Polypeptide
EVQLVESGGGLVQPGGSLRLSCAASGFTLSSSSIHWVRQAPGKGLEWVASIYSSYGSTSYADSVKGRFTISADTSKNTAYLQMNSLRAEDTAVYYCARSSHWYMYWSYWGWYIGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 281 - protein, 453 aa, Artificial Sequence
  Synthetic Polypeptide
EVQLVESGGGLVQPGGSLRLSCAASGFTVSSSSIHWVRQAPGKGLEWVASISSYYGYTYYADSVKGRFTISADTSKNTAYLQMNSLRAEDTAVYYCARSYSYGYDYFVKYYTMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 282 - protein, 454 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSWGGIGKWVWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 283 - protein, 454 aa, Artificial Sequence
  Synthetic Polypeptide
EVQLVESGGGLVQPGGSLRLSCAASGFTVSSSSIHWVRQAPGKGLEWVASSSSSSGYTSYADSVKGRFTISADTSKNTAYLQMNSLRAEDTAVYYCARYSTYSWGGIGKWVWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 284 - protein, 454 aa, Artificial Sequence
  Synthetic Polypeptide
EVQLVESGGGLVQPGGSLRLSCAASGFTVSSSSIHWVRQAPGKGLEWVAYIYPYSSSSSYADSVKGRFTISADTSKNTAYLQMNSLRAEDTAVYYCARYSTYSWGGIGKWVWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 285 - protein, 454 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARSSSSSWGGIGKWVWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 286 - protein, 454 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSSSSSSKWVWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 287 - protein, 454 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSWGGIGSSSSSMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 288 - protein, 453 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSSSSSKWVWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 289 - protein, 452 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSSSSKWVWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 290 - protein, 451 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSSSKWVWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 291 - protein, 450 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSSKWVWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 292 - protein, 449 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYSKWVWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 293 - protein, 448 aa, Artificial Sequence
  Synthetic Polypeptide
EVQLVESGGGLVQPGGSLRLSCAASGFTVSSSSIHWVRQAPGKGLEWVAYIYPYSGYTSYADSVKGRFTISADTSKNTAYLQMNSLRAEDTAVYYCARYSTYKWVWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 294 - protein, 451 aa, Artificial Sequence
  Synthetic Polypeptide
EVQLVESGGGLVQPGGSLRLSCAASGFTVSSSSIHWVRQAPGKGLEWVAYIYPYSSSSSYADSVKGRFTISADTSKNTAYLQMNSLRAEDTAVYYCARYSTYSSSKWVWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 295 - protein, 450 aa, Artificial Sequence
  Synthetic Polypeptide
EVQLVESGGGLVQPGGSLRLSCAASGFTVSSSSIHWVRQAPGKGLEWVAYIYPYSSSSSYADSVKGRFTISADTSKNTAYLQMNSLRAEDTAVYYCARYSTYSSKWVWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 296 - protein, 448 aa, Artificial Sequence
  Synthetic Polypeptide
EVQLVESGGGLVQPGGSLRLSCAASGFTVSSSSIHWVRQAPGKGLEWVAYIYPYSSSSSYADSVKGRFTISADTSKNTAYLQMNSLRAEDTAVYYCARYSTYKWVWGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 297 - protein, 451 aa, Artificial Sequence
  Synthetic Polypeptide
EVQLVESGGGLVQPGGSLRLSCAASGFTVSSSSIHWVRQAPGKGLEWVAYIYSSSGYTSYADSVKGRFTISADTSKNTAYLQMNSLRAEDTAVYYCARYSSYHYPYWLFAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 298 - protein, 456 aa, Artificial Sequence
  Synthetic Polypeptide
EVQLVESGGGLVQPGGSLRLSCAASGFTVSYSSIHWVRQAPGKGLEWVASIYSYYGSTYYADSVKGRFTISADTSKNTAYLQMNSLRAEDTAVYYCARGHYQEGRKSGFSYWSPALDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 299 - protein, 457 aa, Artificial Sequence
  Synthetic Polypeptide
EVQLVESGGGLVQPGGSLRLSCAASGFTVYSSSIHWVRQAPGKGLEWVASIYSYYGYTSYADSVKGRFTISADTSKNTAYLQMNSLRAEDTAVYYCARSTEGYDRWGYYSSYWSSGLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 300 - protein, 454 aa, Artificial Sequence
  Synthetic Polypeptide
EVQLVESGGGLVQPGGSLRLSCAASGFTLYSSSIHWVRQAPGKGLEWVASIYSSSGYTYYADSVKGRFTISADTSKNTAYLQMNSLRAEDTAVYYCARTYTWKSSWSYQTGYGLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 301 - protein, 456 aa, Artificial Sequence
  Synthetic Polypeptide
EVQLVESGGGLVQPGGSLRLSCAASGFTFSSSSIHWVRQAPGKGLEWVASISPYYGSTYYADSVKGRFTISADTSKNTAYLQMNSLRAEDTAVYYCARAVYYYVYNRSWYWWSGGFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 302 - protein, 453 aa, Artificial Sequence
  Synthetic Polypeptide
EVQLVESGGGLVQPGGSLRLSCAASGFTFSSSSIHWVRQAPGKGLEWVASISSSSGSTSYADSVKGRFTISADTSKNTAYLQMNSLRAEDTAVYYCARPAYSYPYYYFHYGAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 303 - protein, 452 aa, Artificial Sequence
  Synthetic Polypeptide
EVQLVESGGGLVQPGGSLRLSCAASGFTFSSSSIHWVRQAPGKGLEWVASIYPSYGYTSYADSVKGRFTISADTSKNTAYLQMNSLRAEDTAVYYCARAWYHHEYWGHYSGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 304 - protein, 452 aa, Artificial Sequence
  Synthetic Polypeptide
EVQLVESGGGLVQPGGSLRLSCAASGFTFSSSSIHWVRQAPGKGLEWVASIYSSYGSTYYADSVKGRFTISADTSKNTAYLQMNSLRAEDTAVYYCARSGYSHPYYSYYSGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 305 - protein, 454 aa, Artificial Sequence
  Synthetic Polypeptide
EVQLVESGGGLVQPGGSLRLSCAASGFTFSSSSIHWVRQAPGKGLEWVASIYSYSGYTYYADSVKGRFTISADTSKNTAYLQMNSLRAEDTAVYYCARTYMAGYKYYFISGYGFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 306 - protein, 451 aa, Artificial Sequence
  Synthetic Polypeptide
EVQLVESGGGLVQPGGSLRLSCAASGFTFSYSSIHWVRQAPGKGLEWVASIYPSYGYTYYADSVKGRFTISADTSKNTAYLQMNSLRAEDTAVYYCARYWDYGWMYFDPAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 307 - protein, 451 aa, Artificial Sequence
  Synthetic Polypeptide
EVQLVESGGGLVQPGGSLRLSCAASGFTFSYSSIHWVRQAPGKGLEWVASIYSYSGYTSYADSVKGRFTISADTSKNTAYLQMNSLRAEDTAVYYCARYMENWEWPYHSAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 308 - protein, 457 aa, Artificial Sequence
  Synthetic Polypeptide
EVQLVESGGGLVQPGGSLRLSCAASGFTFYSSSIHWVRQAPGKGLEWVASIYSSYGSTYYADSVKGRFTISADTSKNTAYLQMNSLRAEDTAVYYCARSWWYPYWQYYPGGWHSSGFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 309 - protein, 451 aa, Artificial Sequence
  Synthetic Polypeptide
EVQLVESGGGLVQPGGSLRLSCAASGFTFYSSSIHWVRQAPGKGLEWVAYISPSSGYTSYADSVKGRFTISADTSKNTAYLQMNSLRAEDTAVYYCARYTMTYQYYPSGAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 310 - protein, 456 aa, Artificial Sequence
  Synthetic Polypeptide
EVQLVESGGGLVQPGGSLRLSCAASGFTIYSSYIHWVRQAPGKGLEWVASIYSSSGYTYYADSVKGRFTISADTSKNTAYLQMNSLRAEDTAVYYCARSYIYYMWQYNYGMSGYGLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 311 - protein, 452 aa, Artificial Sequence
  Synthetic Polypeptide
EVQLVESGGGLVQPGGSLRLSCAASGFTLSYSSIHWVRQAPGKGLEWVASISSSYGYTYYADSVKGRFTISADTSKNTAYLQMNSLRAEDTAVYYCARHSPYYLHSWWWSGLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 312 - protein, 450 aa, Artificial Sequence
  Synthetic Polypeptide
EVQLVESGGGLVQPGGSLRLSCAASGFTLYYSSIHWVRQAPGKGLEWVASISPSYGSTSYADSVKGRFTISADTSKNTAYLQMNSLRAEDTAVYYCARHSWYYPYYYYALDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 313 - protein, 450 aa, Artificial Sequence
  Synthetic Polypeptide
EVQLVESGGGLVQPGGSLRLSCAASGFTVSSSSIHWVRQAPGKGLEWVASISSSSGYTYYADSVKGRFTISADTSKNTAYLQMNSLRAEDTAVYYCARYWSYPYVYFLAFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 314 - protein, 456 aa, Artificial Sequence
  Synthetic Polypeptide
EVQLVESGGGLVQPGGSLRLSCAASGFTVSSSSIHWVRQAPGKGLEWVASIYSSSGYTSYADSVKGRFTISADTSKNTAYLQMNSLRAEDTAVYYCARNVENYPYWAWPWGYYGAIDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 315 - protein, 450 aa, Artificial Sequence
  Synthetic Polypeptide
EVQLVESGGGLVQPGGSLRLSCAASGFTVSSSSIHWVRQAPGKGLEWVASIYSSSGYTYYADSVKGRFTISADTSKNTAYLQMNSLRAEDTAVYYCARTYKWSYYTGYGFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 316 - protein, 451 aa, Artificial Sequence
  Synthetic Polypeptide
EVQLVESGGGLVQPGGSLRLSCAASGFTVSSSSIHWVRQAPGKGLEWVAYISSSSGYTYYADSVKGRFTISADTSKNTAYLQMNSLRAEDTAVYYCARYWSYPSWWPYRGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 317 - protein, 451 aa, Artificial Sequence
  Synthetic Polypeptide
EVQLVESGGGLVQPGGSLRLSCAASGFTVSSSSIHWVRQAPGKGLEWVAYISSSSGYTYYADSVKGRFTISADTSKNTAYLQMNSLRAEDTAVYYCARYWSYPSWSPYRGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 318 - protein, 452 aa, Artificial Sequence
  Synthetic Polypeptide
EVQLVESGGGLVQPGGSLRLSCAASGFTVSSYSIHWVRQAPGKGLEWVAYIYSSSGYTSYADSVKGRFTISADTSKNTAYLQMNSLRAEDTAVYYCARVGYYYPYLYLGDGLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 319 - protein, 457 aa, Artificial Sequence
  Synthetic Polypeptide
EVQLVESGGGLVQPGGSLRLSCAASGFTVSSYSIHWVRQAPGKGLEWVASISSSSGSTSYADSVKGRFTISADTSKNTAYLQMNSLRAEDTAVYYCARNAWHYEPSYWYGNYATYGFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 320 - protein, 450 aa, Artificial Sequence
  Synthetic Polypeptide
EVQLVESGGGLVQPGGSLRLSCAASGFTVSYSSIHWVRQAPGKGLEWVASISSSSSSTYYADSVKGRFTISADTSKNTAYLQMNSLRAEDTAVYYCARGQQYYPDQYWGLDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 321 - protein, 455 aa, Artificial Sequence
  Synthetic Polypeptide
EVQLVESGGGLVQPGGSLRLSCAASGFTVSYSSIHWVRQAPGKGLEWVASIYSSSGYTYYADSVKGRFTISADTSKNTAYLQMNSLRAEDTAVYYCARTYYTYFDWWRTAVYYGFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 322 - protein, 453 aa, Artificial Sequence
  Synthetic Polypeptide
EVQLVESGGGLVQPGGSLRLSCAASGFTVYSSSIHWVRQAPGKGLEWVASISSSYGYTSYADSVKGRFTISADTSKNTAYLQMNSLRAEDTAVYYCARDYYNYMSSYWWYSALDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 323 - protein, 455 aa, Artificial Sequence
  Synthetic Polypeptide
EVQLVESGGGLVQPGGSLRLSCAASGFTVYSSSIHWVRQAPGKGLEWVASIYPYYGYTSYADSVKGRFTISADTSKNTAYLQMNSLRAEDTAVYYCARKIFWPVSWMWQGYYPALDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 324 - protein, 450 aa, Artificial Sequence
  Synthetic Polypeptide
EVQLVESGGGLVQPGGSLRLSCAASGFTVYSSSIHWVRQAPGKGLEWVASIYSSYGYTSYADSVKGRFTISADTSKNTAYLQMNSLRAEDTAVYYCARSYSSETHYGWAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 325 - protein, 454 aa, Artificial Sequence
  Synthetic Polypeptide
EVQLVESGGGLVQPGGSLRLSCAASGFTLSSSSIHWVRQAPGKGLEWVASIYSSYGSTSYADSVKGRFTISADTSKNTAYLQMNSLRAEDTAVYYCARQYYTYFEWYMGWGYALDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 326 - protein, 452 aa, Artificial Sequence
  Synthetic Polypeptide
EVQLVESGGGLVQPGGSLRLSCAASGFTVSSSSIHWVRQAPGKGLEWVAYISSYSGSTYYADSVKGRFTISADTSKNTAYLQMNSLRAEDTAVYYCARSSALYWMDFSYSALDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 327 - protein, 451 aa, Artificial Sequence
  Synthetic Polypeptide
EVQLVESGGGLVQPGGSLRLSCAASGFTVSSSSIHWVRQAPGKGLEWVAYISSSSGYTYYADSVKGRFTISADTSKNTAYLQMNSLRAEDTAVYYCARSSSSSSSSSSSSSDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 328 - protein, 11 aa, Artificial Sequence
  Synthetic Polypeptide
RASQSVSSAVA

SEQ ID NO: 329 - protein, 7 aa, Artificial Sequence
  Synthetic Polypeptide
SASSLYS

SEQ ID NO: 330 - protein, 10 aa, Artificial Sequence
  Synthetic Polypeptide
QQSWVGSLIT

SEQ ID NO: 331 - protein, 11 aa, Artificial Sequence
  Synthetic Polypeptide
QQWQWGYSLVT

SEQ ID NO: 332 - protein, 11 aa, Artificial Sequence
  Synthetic Polypeptide
QQSWYSNKPIT

SEQ ID NO: 333 - protein, 9 aa, Artificial Sequence
  Synthetic Polypeptide
QQSSSSLIT

SEQ ID NO: 334 - protein, 11 aa, Artificial Sequence
  Synthetic Polypeptide
QQYYGWFYPVT

SEQ ID NO: 335 - protein, 9 aa, Artificial Sequence
  Synthetic Polypeptide
QQYHSSLFT

SEQ ID NO: 336 - protein, 11 aa, Artificial Sequence
  Synthetic Polypeptide
QQYPGYRGLIT

SEQ ID NO: 337 - protein, 11 aa, Artificial Sequence
  Synthetic Polypeptide
QQSYYDSNPIT

SEQ ID NO: 338 - protein, 11 aa, Artificial Sequence
  Synthetic Polypeptide
QQSYFHKIPIT

SEQ ID NO: 339 - protein, 10 aa, Artificial Sequence
  Synthetic Polypeptide
QQWYWYYPVT

SEQ ID NO: 340 - protein, 9 aa, Artificial Sequence
  Synthetic Polypeptide
QQTYWGLIT

SEQ ID NO: 341 - protein, 10 aa, Artificial Sequence
  Synthetic Polypeptide
QQYKSKYPFT

SEQ ID NO: 342 - protein, 10 aa, Artificial Sequence
  Synthetic Polypeptide
CQQSSSSLIT

SEQ ID NO: 343 - protein, 9 aa, Artificial Sequence
  Synthetic Polypeptide
QQSSWGLIT

SEQ ID NO: 344 - protein, 10 aa, Artificial Sequence
  Synthetic Polypeptide
QQFWGSKLFT

SEQ ID NO: 345 - protein, 11 aa, Artificial Sequence
  Synthetic Polypeptide
QQMYYPGYLIT

SEQ ID NO: 346 - protein, 10 aa, Artificial Sequence
  Synthetic Polypeptide
QQDRWWSALT

SEQ ID NO: 347 - protein, 11 aa, Artificial Sequence
  Synthetic Polypeptide
QQSYGSWYPIT

SEQ ID NO: 348 - protein, 10 aa, Artificial Sequence
  Synthetic Polypeptide
QQGWYASPIT

SEQ ID NO: 349 - protein, 11 aa, Artificial Sequence
  Synthetic Polypeptide
QQYSSHKYPFT

SEQ ID NO: 350 - protein, 11 aa, Artificial Sequence
  Synthetic Polypeptide
QQWVYPGSLIT

SEQ ID NO: 351 - protein, 10 aa, Artificial Sequence
  Synthetic Polypeptide
QQYKSKYPFT

SEQ ID NO: 352 - protein, 9 aa, Artificial Sequence
  Synthetic Polypeptide
QQSSTDPIT

SEQ ID NO: 353 - protein, 9 aa, Artificial Sequence
  Synthetic Polypeptide
QQSSTDPIT

SEQ ID NO: 354 - protein, 10 aa, Artificial Sequence
  Synthetic Polypeptide
QQSSQYDLIT

SEQ ID NO: 355 - protein, 10 aa, Artificial Sequence
  Synthetic Polypeptide
QQSSSSSLFT

SEQ ID NO: 356 - protein, 11 aa, Artificial Sequence
  Synthetic Polypeptide
QQRWYPGDLIT

SEQ ID NO: 357 - protein, 10 aa, Artificial Sequence
  Synthetic Polypeptide
QQSYFPSLVT

SEQ ID NO: 358 - protein, 9 aa, Artificial Sequence
  Synthetic Polypeptide
QQWSQSPVT

SEQ ID NO: 359 - protein, 10 aa, Artificial Sequence
  Synthetic Polypeptide
QQSYVYYPFT

SEQ ID NO: 360 - protein, 11 aa, Artificial Sequence
  Synthetic Polypeptide
QQGGWYYGPIT

SEQ ID NO: 361 - protein, 9 aa, Artificial Sequence
  Synthetic Polypeptide
FTVSSSSIH

SEQ ID NO: 362 - protein, 17 aa, Artificial Sequence
  Synthetic Polypeptide
SISPSYGSTSYADSVKG

SEQ ID NO: 363 - protein, 17 aa, Artificial Sequence
  Synthetic Polypeptide
YIYSSSGYTSYADSVKG

SEQ ID NO: 364 - protein, 17 aa, Artificial Sequence
  Synthetic Polypeptide
YIYPYSGYTSYADSVKG

SEQ ID NO: 365 - protein, 17 aa, Artificial Sequence
  Synthetic Polypeptide
SSSSSSGYTSYADSVKG

SEQ ID NO: 366 - protein, 17 aa, Artificial Sequence
  Synthetic Polypeptide
YIYPYSSSSSYADSVKG

SEQ ID NO: 367 - protein, 18 aa, Artificial Sequence
  Synthetic Polypeptide
YYWGWSQNQGFWWYGLDY

SEQ ID NO: 368 - protein, 14 aa, Artificial Sequence
  Synthetic Polypeptide
SWSSSFWYNWALDY

SEQ ID NO: 369 - protein, 16 aa, Artificial Sequence
  Synthetic Polypeptide
YSHSSLYYSWIWALDY

SEQ ID NO: 370 - protein, 14 aa, Artificial Sequence
  Synthetic Polypeptide
SYRPYSSYYWGMDY

SEQ ID NO: 371 - protein, 19 aa, Artificial Sequence
  Synthetic Polypeptide
SVSWYPYYYYYGYGSGLDY

SEQ ID NO: 372 - protein, 19 aa, Artificial Sequence
  Synthetic Polypeptide
SSHWYMYWSYWGWYIGMDY

SEQ ID NO: 373 - protein, 17 aa, Artificial Sequence
  Synthetic Polypeptide
SYSYGYDYFVKYYTMDY

SEQ ID NO: 374 - protein, 18 aa, Artificial Sequence
  Synthetic Polypeptide
YSTYSWGGIGKWVWGMDY

SEQ ID NO: 375 - protein, 18 aa, Artificial Sequence
  Synthetic Polypeptide
SSSSSWGGIGKWVWGMDY

SEQ ID NO: 376 - protein, 18 aa, Artificial Sequence
  Synthetic Polypeptide
YSTYSSSSSSKWVWGMDY

SEQ ID NO: 377 - protein, 18 aa, Artificial Sequence
  Synthetic Polypeptide
YSTYSWGGIGSSSSSMDY

SEQ ID NO: 378 - protein, 17 aa, Artificial Sequence
  Synthetic Polypeptide
YSTYSSSSSKWVWGMDY

SEQ ID NO: 379 - protein, 16 aa, Artificial Sequence
  Synthetic Polypeptide
YSTYSSSSKWVWGMDY

SEQ ID NO: 380 - protein, 15 aa, Artificial Sequence
  Synthetic Polypeptide
YSTYSSSKWVWGMDY

SEQ ID NO: 381 - protein, 13 aa, Artificial Sequence
  Synthetic Polypeptide
YSTYSKWVWGMDY

SEQ ID NO: 382 - protein, 12 aa, Artificial Sequence
  Synthetic Polypeptide
YSTYKWVWGMDY

SEQ ID NO: 383 - protein, 14 aa, Artificial Sequence
  Synthetic Polypeptide
YSTYSSKWVWGMDY

SEQ ID NO: 384 - protein, 15 aa, Artificial Sequence
  Synthetic Polypeptide
YSSYHYPYWLFAMDY

SEQ ID NO: 385 - protein, 20 aa, Artificial Sequence
  Synthetic Polypeptide
GHYQEGRKSGFSYWSPALDY

SEQ ID NO: 386 - protein, 21 aa, Artificial Sequence
  Synthetic Polypeptide
STEGYDRWGYYSSYWSSGLDY

SEQ ID NO: 387 - protein, 17 aa, Artificial Sequence
  Synthetic Polypeptide
YISPSSGYTSYADSVKG

SEQ ID NO: 388 - protein, 17 aa, Artificial Sequence
  Synthetic Polypeptide
YISSSSGYTYYADSVKG

SEQ ID NO: 389 - protein, 17 aa, Artificial Sequence
  Synthetic Polypeptide
YISSYSGSTYYADSVKG

SEQ ID NO: 390 - protein, 18 aa, Artificial Sequence
  Synthetic Polypeptide
TYTWKSSWSYQTGYGLDY

SEQ ID NO: 391 - protein, 20 aa, Artificial Sequence
  Synthetic Polypeptide
AVYYYVYNRSWYWWSGGFDY

SEQ ID NO: 392 - protein, 17 aa, Artificial Sequence
  Synthetic Polypeptide
PAYSYPYYYFHYGAMDY

SEQ ID NO: 393 - protein, 16 aa, Artificial Sequence
  Synthetic Polypeptide
AWYHHEYWGHYSGMDY

SEQ ID NO: 394 - protein, 16 aa, Artificial Sequence
  Synthetic Polypeptide
SGYSHPYYSYYSGMDY

SEQ ID NO: 395 - protein, 18 aa, Artificial Sequence
  Synthetic Polypeptide
TYMAGYKYYFISGYGFDY

SEQ ID NO: 396 - protein, 15 aa, Artificial Sequence
  Synthetic Polypeptide
YWDYGWMYFDPAMDY

SEQ ID NO: 397 - protein, 15 aa, Artificial Sequence
  Synthetic Polypeptide
YMENWEWPYHSAMDY

SEQ ID NO: 398 - protein, 21 aa, Artificial Sequence
  Synthetic Polypeptide
SWWYPYWQYYPGGWHSSGFDY

SEQ ID NO: 399 - protein, 15 aa, Artificial Sequence
  Synthetic Polypeptide
YTMTYQYYPSGAMDY

SEQ ID NO: 400 - protein, 20 aa, Artificial Sequence
  Synthetic Polypeptide
SYIYYMWQYNYGMSGYGLDY

SEQ ID NO: 401 - protein, 16 aa, Artificial Sequence
  Synthetic Polypeptide
HSPYYLHSWWWSGLDY

SEQ ID NO: 402 - protein, 14 aa, Artificial Sequence
  Synthetic Polypeptide
HSWYYPYYYYALDY

SEQ ID NO: 403 - protein, 14 aa, Artificial Sequence
  Synthetic Polypeptide
YWSYPYVYFLAFDY

SEQ ID NO: 404 - protein, 20 aa, Artificial Sequence
  Synthetic Polypeptide
NVENYPYWAWPWGYYGAIDY

SEQ ID NO: 405 - protein, 14 aa, Artificial Sequence
  Synthetic Polypeptide
TYKWSYYTGYGFDY

SEQ ID NO: 406 - protein, 15 aa, Artificial Sequence
  Synthetic Polypeptide
YWSYPSWWPYRGMDY

SEQ ID NO: 407 - protein, 15 aa, Artificial Sequence
  Synthetic Polypeptide
YWSYPSWSPYRGMDY

SEQ ID NO: 408 - protein, 16 aa, Artificial Sequence
  Synthetic Polypeptide
VGYYYPYLYLGDGLDY

SEQ ID NO: 409 - protein, 21 aa, Artificial Sequence
  Synthetic Polypeptide
NAWHYEPSYWYGNYATYGFDY

SEQ ID NO: 410 - protein, 14 aa, Artificial Sequence
  Synthetic Polypeptide
GQQYYPDQYWGLDY

SEQ ID NO: 411 - protein, 19 aa, Artificial Sequence
  Synthetic Polypeptide
TYYTYFDWWRTAVYYGFDY

SEQ ID NO: 412 - protein, 17 aa, Artificial Sequence
  Synthetic Polypeptide
DYYNYMSSYWWYSALDY

SEQ ID NO: 413 - protein, 19 aa, Artificial Sequence
  Synthetic Polypeptide
KIFWPVSWMWQGYYPALDY

SEQ ID NO: 414 - protein, 14 aa, Artificial Sequence
  Synthetic Polypeptide
SYSSETHYGWAMDY

SEQ ID NO: 415 - protein, 18 aa, Artificial Sequence
  Synthetic Polypeptide
QYYTYFEWYMGWGYALDY

SEQ ID NO: 416 - protein, 16 aa, Artificial Sequence
  Synthetic Polypeptide
SSALYWMDFSYSALDY

SEQ ID NO: 417 - protein, 15 aa, Artificial Sequence
  Synthetic Polypeptide
SSSSSSSSSSSSSDY

SEQ ID NO: 418 - protein, 106 aa, Artificial Sequence
  Synthetic Polypeptide
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 419 - protein, 330 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 420 - protein, 330 aa, Artificial Sequence
  Synthetic Polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 421 - protein, 327 aa, Artificial Sequence
  Synthetic Polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 422 - protein, 327 aa, Artificial Sequence
  Synthetic Polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSPGK

SEQ ID NO: 423 - protein, 327 aa, Artificial Sequence
  Synthetic Polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 424 - protein, 9 aa, Artificial Sequence
  Synthetic Polypeptide
FTLYSSSIH

SEQ ID NO: 425 - protein, 9 aa, Artificial Sequence
  Synthetic Polypeptide
FTFSYSSIH

SEQ ID NO: 426 - protein, 9 aa, Artificial Sequence
  Synthetic Polypeptide
FTFYSSSIH

SEQ ID NO: 427 - protein, 9 aa, Artificial Sequence
  Synthetic Polypeptide
FTLSSSSIH

SEQ ID NO: 428 - protein, 9 aa, Artificial Sequence
  Synthetic Polypeptide
FTVYSSSIH

SEQ ID NO: 429 - protein, 9 aa, Artificial Sequence
  Synthetic Polypeptide
FTVSYSSIH

SEQ ID NO: 430 - protein, 9 aa, Artificial Sequence
  Synthetic Polypeptide
FTVSSYSIH

SEQ ID NO: 431 - protein, 9 aa, Artificial Sequence
  Synthetic Polypeptide
FTFSSSSIH

SEQ ID NO: 432 - protein, 9 aa, Artificial Sequence
  Synthetic Polypeptide
FTIYSSYIH

SEQ ID NO: 433 - protein, 9 aa, Artificial Sequence
  Synthetic Polypeptide
FTLSYSSIH

SEQ ID NO: 434 - protein, 9 aa, Artificial Sequence
  Synthetic Polypeptide
FTLYYSSIH

SEQ ID NO: 435 - protein, 9 aa, Artificial Sequence
  Synthetic Polypeptide
FTISSSSIH

SEQ ID NO: 436 - protein, 9 aa, Artificial Sequence
  Synthetic Polypeptide
FTIYSSSIH

SEQ ID NO: 437 - protein, 9 aa, Artificial Sequence
  Synthetic Polypeptide
FTIYYSSIH

SEQ ID NO: 438 - protein, 17 aa, Artificial Sequence
  Synthetic Polypeptide
SIYSSYGYTYYADSVKG

SEQ ID NO: 439 - protein, 17 aa, Artificial Sequence
  Synthetic Polypeptide
SISSYYGSTYYADSVKG

SEQ ID NO: 440 - protein, 17 aa, Artificial Sequence
  Synthetic Polypeptide
SISSSSGSTSYADSVKG

SEQ ID NO: 441 - protein, 17 aa, Artificial Sequence
  Synthetic Polypeptide
SISSSYGSTYYADSVKG

SEQ ID NO: 442 - protein, 17 aa, Artificial Sequence
  Synthetic Polypeptide
SIYSSYGSTSYADSVKG

SEQ ID NO: 443 - protein, 17 aa, Artificial Sequence
  Synthetic Polypeptide
SISSYYGYTYYADSVKG

SEQ ID NO: 444 - protein, 17 aa, Artificial Sequence
  Synthetic Polypeptide
SIYSYYGSTYYADSVKG

SEQ ID NO: 445 - protein, 17 aa, Artificial Sequence
  Synthetic Polypeptide
SIYSYYGYTSYADSVKG

SEQ ID NO: 446 - protein, 17 aa, Artificial Sequence
  Synthetic Polypeptide
SIYSSSGYTYYADSVKG

SEQ ID NO: 447 - protein, 17 aa, Artificial Sequence
  Synthetic Polypeptide
SISPYYGSTYYADSVKG

SEQ ID NO: 448 - protein, 17 aa, Artificial Sequence
  Synthetic Polypeptide
SISSSSGSTSYADSVKG

SEQ ID NO: 449 - protein, 17 aa, Artificial Sequence
  Synthetic Polypeptide
SIYPSYGYTSYADSVKG

SEQ ID NO: 450 - protein, 17 aa, Artificial Sequence
  Synthetic Polypeptide
SIYSSYGSTYYADSVKG

SEQ ID NO: 451 - protein, 17 aa, Artificial Sequence
  Synthetic Polypeptide
SIYSYSGYTYYADSVKG

SEQ ID NO: 452 - protein, 17 aa, Artificial Sequence
  Synthetic Polypeptide
SIYPSYGYTYYADSVKG

SEQ ID NO: 453 - protein, 17 aa, Artificial Sequence
  Synthetic Polypeptide
SIYSYSGYTSYADSVKG

SEQ ID NO: 454 - protein, 17 aa, Artificial Sequence
  Synthetic Polypeptide
SIYSSYGSTYYADSVKG

SEQ ID NO: 455 - protein, 17 aa, Artificial Sequence
  Synthetic Polypeptide
SIYSSSGYTYYADSVKG

SEQ ID NO: 456 - protein, 17 aa, Artificial Sequence
  Synthetic Polypeptide
SISSSYGYTYYADSVKG

SEQ ID NO: 457 - protein, 17 aa, Artificial Sequence
  Synthetic Polypeptide
SISSSSGYTYYADSVKG

SEQ ID NO: 458 - protein, 17 aa, Artificial Sequence
  Synthetic Polypeptide
SIYSSSGYTSYADSVKG

SEQ ID NO: 459 - protein, 17 aa, Artificial Sequence
  Synthetic Polypeptide
SIYSSSGYTYYADSVKG

SEQ ID NO: 460 - protein, 17 aa, Artificial Sequence
  Synthetic Polypeptide
SISSSSGSTSYADSVKG

SEQ ID NO: 461 - protein, 17 aa, Artificial Sequence
  Synthetic Polypeptide
SISSSSSSTYYADSVKG

SEQ ID NO: 462 - protein, 17 aa, Artificial Sequence
  Synthetic Polypeptide
SIYSSSGYTYYADSVKG

SEQ ID NO: 463 - protein, 17 aa, Artificial Sequence
  Synthetic Polypeptide
SISSSYGYTSYADSVKG

SEQ ID NO: 464 - protein, 17 aa, Artificial Sequence
  Synthetic Polypeptide
SIYPYYGYTSYADSVKG

SEQ ID NO: 465 - protein, 17 aa, Artificial Sequence
  Synthetic Polypeptide
SIYSSYGYTSYADSVKG

SEQ ID NO: 466 - protein, 17 aa, Artificial Sequence
  Synthetic Polypeptide
SIYSSYGSTSYADSVKG

SEQ ID NO: 467 - protein, 17 aa, Artificial Sequence
  Synthetic Polypeptide
  misc_feature (1)..(1): Xaa is Tyr or Ser
  misc_feature (2)..(2): Xaa is Ile or Ser
  misc_feature (3)..(3): Xaa is Tyr or Ser
  misc_feature (4)..(4): Xaa is Pro or Ser
  misc_feature (5)..(5): Xaa is Tyr or Ser
  misc_feature (7)..(7): Xaa is Gly or Ser
  misc_feature (8)..(8): Xaa is Tyr or Ser
  misc_feature (9)..(9): Xaa is Thr or Ser
XXXXXSXXXSYADSVKG

SEQ ID NO: 468 - protein, 19 aa, Artificial Sequence
  Synthetic Polypeptide
  misc_feature (1)..(1): Xaa is Tyr or Ser
  misc_feature (3)..(3): Xaa is Thr, Ser, or absent
  misc_feature (4)..(4): Xaa is Tyr, Ser, or absent
  misc_feature (5)..(5): Xaa is Ser or absent
  misc_feature (6)..(6): Xaa is Trp, Ser, or absent
  misc_feature (7)..(7): Xaa is Ser or absent
  misc_feature (8)..(8): Xaa is Gly, Ser, or absent
  misc_feature (9)..(9): Xaa is Gly, Thr, Ser, or absent
  misc_feature (10)..(10): Xaa is Ile, Tyr, Ser, or absent
  misc_feature (11)..(11): Xaa is Gly, Ser, or Tyr
  misc_feature (13)..(13): Xaa is Trp or Ser
  misc_feature (14)..(14): Xaa is Val or Ser
  misc_feature (15)..(15): Xaa is Trp or Ser
XSXXXXXXXXXKXXXGMDY

What is claimed is:

1. An isolated antibody, which binds human galactin-9, wherein the antibody comprises a heavy chain complementarity determining region 1 (CDR1) set forth as SEQ ID NO: 361, a heavy chain complementary determining region 2 (CDR2) set forth as SEQ ID NO: 388, and a heavy chain complementary determining region 3 (CDR3) set forth as SEQ ID NO: 406 and/or comprises a light chain complementarity determining region 1 (CDR1) set forth as SEQ ID NO: 328, a light chain complementary determining region 2 (CDR2) set forth as SEQ ID NO: 329, and a light chain complementary determining region 3 (CDR3) set forth as SEQ ID NO: 352.

2. The isolated antibody of claim 1, wherein the antibody binds to an epitope in a carbohydrate recognition domain (CRD) of galectin-9.

3. The isolated antibody of claim 2, wherein the CRD is CRD2.

4. The isolated antibody of claim 3, wherein the CRD2 consists of the amino acid sequence of SEQ ID NO: 4.

5. The isolated antibody of claim 1, which is a full-length antibody or an antigen-binding fragment thereof.

6. The isolated antibody of claim 1, which is a single chain antibody.

7. The isolated antibody of claim 1, which is a human antibody or a humanized antibody.

8. The isolated antibody of claim 1, wherein the antibody comprises a VH set forth as SEQ ID NO: 55 and a VL set forth as SEQ ID NO: 54.

9. The isolated antibody of claim 8, wherein the antibody binds to an epitope in a carbohydrate recognition domain (CRD) of galectin-9, wherein the CRD is CRD2.

10. The isolated antibody of claim 8, which is a full-length antibody or an antigen-binding fragment thereof.

11. The isolated antibody of claim 8, which is a single chain antibody.

12. The isolated antibody of claim 8, which is a human antibody or a humanized antibody.

13. The isolated antibody of claim 8, which is an IgG molecule.

14. The isolated antibody of claim 13, wherein the antibody is an IgG1 or IgG4 molecule.

15. The isolated antibody of claim 14, wherein the antibody is an IgG4 molecule, wherein the IgG4 has a S228P mutation.

16. The isolated antibody of claim 14, wherein the antibody comprises a heavy chain constant region set forth as SEQ ID NO: 422, and/or a light chain constant region set forth as SEQ ID NO: 418.

17. The isolated antibody of claim 8, wherein the antibody comprises a $V_H$ set forth as SEQ ID NO: 55 and a $V_L$ set forth as SEQ ID NO: 54, and has a heavy chain constant region set forth as SEQ ID NO: 422 and a light chain constant region set forth as SEQ ID NO: 418.

18. The isolated antibody of claim 17, wherein the antibody comprises a heavy chain set forth as SEQ ID NO: 316 and a light chain set forth as SEQ ID NO:108.

19. The isolated antibody of claim 18, wherein the antibody is G9.2-17.

20. The isolated antibody of claim 19, wherein the antibody binds to an epitope in a carbohydrate recognition domain (CRD) of galectin-9, wherein the CRD is CRD2.

21. A pharmaceutical composition comprising the antibody of claim 19 and a pharmaceutically acceptable carrier.

22. A pharmaceutical composition comprising the antibody of claim 17 and a pharmaceutically acceptable carrier.

23. A pharmaceutical composition comprising the antibody of claim 8 and a pharmaceutically acceptable carrier.

24. The isolated antibody of claim 1, which is an IgG molecule.

25. The isolated antibody of claim 24, wherein the antibody is an IgG1 or IgG4 molecule.

26. The isolated antibody of claim 25, wherein the antibody is an IgG4 molecule, wherein the IgG4 has a S228P mutation.

27. The isolated antibody of claim 25, wherein the antibody comprises a heavy chain constant region set forth as SEQ ID NO: 422, and/or a light chain constant region set forth as SEQ ID NO: 418.

28. The isolated antibody of claim 1, wherein the antibody has a $V_L$ CDR1 set forth as SEQ ID NO: 328, a $V_L$ CDR2 set forth as SEQ ID NO: 329, a $V_L$ CDR3 set forth as SEQ ID NO: 352, a $V_H$ CDR1 set forth as SEQ ID NO: 361, a $V_H$ CDR2 set forth as SEQ ID NO: 388, a $V_H$ CDR3 set forth as SEQ ID NO: 406, and has a heavy chain constant region set forth as SEQ ID NO: 422 and a light chain constant region set forth as SEQ ID NO: 418.

29. The isolated antibody of claim 1, wherein the antibody comprises a heavy chain set forth as SEQ ID NO: 316 and/or a light chain set forth as SEQ ID NO:108.

30. A pharmaceutical composition comprising the antibody of claim 1 and a pharmaceutically acceptable carrier.

* * * * *

UNITED STATES PATENT AND TRADEMARK OFFICE
CERTIFICATE OF CORRECTION

PATENT NO. : 10,344,091 B2
APPLICATION NO. : 16/173970
DATED : July 9, 2019
INVENTOR(S) : Koide et al.

Page 1 of 1

It is certified that error appears in the above-identified patent and that said Letters Patent is hereby corrected as shown below:

In the Claims

Column 193, Line 15, in Claim 1, "galactin-9" should read: --galectin-9--;

Column 193, Line 18, in Claim 1, "complementary" should read: --complementarity--;

Column 193, Line 20, in Claim 1, "complementary" should read: --complementarity--;

Column 193, Line 23, in Claim 1, "complementary" should read: --complementarity--;

Column 193, Line 25, in Claim 1, "complementary" should read: --complementarity--.

Signed and Sealed this
Twentieth Day of October, 2020

Andrei Iancu
*Director of the United States Patent and Trademark Office*